(12) United States Patent
Zhang et al.

(10) Patent No.: US 12,415,000 B2
(45) Date of Patent: Sep. 16, 2025

(54) CRISPR SYSTEM BASED ANTIVIRAL THERAPY

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Feng Zhang, Cambridge, MA (US); Jonathan S. Gootenberg, Cambridge, MA (US); Omar O. Abudayyeh, Cambridge, MA (US); Pardis Sabeti, Cambridge, MA (US); Cameron Myhrvold, Cambridge, MA (US); Catherine Amanda Freije, Cambridge, MA (US)

(73) Assignees: THE BROAD INSTITUTE, INC., Cambridge, MA (US); MASSACHUETTS INSTITUTE OF TECHNOLOGY, Cambridge, MA (US); PRESIDENT AND FELLOWS OF HARVARD COLLEGE, Cambridge, NC (US)

( * ) Notice: Subject to any disclaimer, the term of this patent is extended or adjusted under 35 U.S.C. 154(b) by 985 days.

(21) Appl. No.: 16/629,310

(22) PCT Filed: Jul. 6, 2018

(86) PCT No.: PCT/US2018/041099
§ 371 (c)(1),
(2) Date: Jan. 7, 2020

(87) PCT Pub. No.: WO2019/010422
PCT Pub. Date: Jan. 10, 2019

(65) Prior Publication Data
US 2020/0165594 A1 May 28, 2020

Related U.S. Application Data

(60) Provisional application No. 62/530,029, filed on Jul. 7, 2017.

(51) Int. Cl.
*A61K 48/00* (2006.01)
*C12N 9/22* (2006.01)
*C12N 15/10* (2006.01)
*C12N 15/113* (2010.01)

(52) U.S. Cl.
CPC ............. *A61K 48/005* (2013.01); *C12N 9/22* (2013.01); *C12N 15/102* (2013.01); *C12N 15/1131* (2013.01); *C12N 2310/20* (2017.05); *C12N 2320/11* (2013.01)

(58) Field of Classification Search
CPC .............. C12N 15/102; C12N 15/1131; C12N 2310/20; C12N 2320/11
See application file for complete search history.

(56) References Cited

U.S. PATENT DOCUMENTS

| | | |
|---|---|---|
| 7,259,015 B2 | 8/2007 | Kingsman et al. |
| 7,303,910 B2 | 12/2007 | Bebbington et al. |
| 7,351,585 B2 | 4/2008 | Mitrophanous et al. |
| 2004/0013648 A1 | 1/2004 | Kingsman et al. |
| 2006/0281180 A1 | 12/2006 | Radcliffe et al. |
| 2007/0025970 A1 | 2/2007 | Kingsman et al. |
| 2007/0054961 A1 | 3/2007 | Maden et al. |
| 2009/0007284 A1 | 1/2009 | Radcliffe et al. |
| 2009/0017543 A1 | 1/2009 | Wilkes et al. |
| 2009/0111106 A1 | 4/2009 | Mitrophanous et al. |
| 2010/0317109 A1 | 12/2010 | Maden et al. |
| 2011/0059502 A1 | 3/2011 | Chalasani |
| 2011/0117189 A1 | 5/2011 | Mazzone et al. |

(Continued)

FOREIGN PATENT DOCUMENTS

| | | |
|---|---|---|
| WO | 96/39154 A1 | 12/1996 |
| WO | 97/03211 A1 | 1/1997 |

(Continued)

OTHER PUBLICATIONS

Zetsche, et al., "Cpf1 is a Single RNA-Guided Endonuclease of a Class 2 CRISPR-Cas System", Cell, vol. 163, No. 3, Oct. 22, 2015, 14 pages.
Wang, et al., "Genetic Screens in Human Cells Using the CRISPR/Cas9 System", Science, vol. 343, No. 6166., Jan. 3, 2014, 12 pages.
Wang, et al., "One-Step Generation of Mice Carrying Mutations in Multiple Genes by CRISPR/Cas-Mediated Genome Engineering", Cell, vol. 153, No. 4, May 9, 2013, 13 pages.
Wu, et al., "Genome-Wide Binding of the CRISCR Endonuclease Cas9 in Mammalian Cells", Nature Biotechnology, vol. 32, No. 7, Jul. 2014, 9 pages.

(Continued)

*Primary Examiner* — Nancy J Leith
(74) *Attorney, Agent, or Firm* — Johnson, Marcou, Isaacs & Nix, LLC; F. Brent Nix, Esq.; Christopher D. Southgate

(57) ABSTRACT

The present invention offers a new approach for highly multiplexed, programmable antiviral therapies that directly target viral RNA, and can be flexibly adapted to target novel viruses or emerging outbreak pathogens. Class 2, type VI CRISPR system-based therapies can be used in combination with existing antiviral compounds for viruses where such compounds exist, either by increasing their efficacy or by preventing the evolution of specific drug resistance mutations. Perhaps most excitingly, if a virus evolves resistance to a specific guide RNA sequence, it is easy to switch to a different guide RNA sequence, or to design a new guide sequence to target the new mutation. Such approaches should prevent the widespread development of resistance to Class 2, type VI CRISPR system-based therapies.

51 Claims, 9 Drawing Sheets
Specification includes a Sequence Listing.

(56) References Cited

U.S. PATENT DOCUMENTS

| | | |
|---|---|---|
| 2011/0293571 A1 | 12/2011 | Widdowson et al. |
| 2012/0295960 A1 | 11/2012 | Palfi et al. |
| 2016/0208243 A1 | 7/2016 | Zhang et al. |
| 2016/0340660 A1 | 11/2016 | Zhang et al. |
| 2017/0166903 A1 | 6/2017 | Zhang et al. |
| 2017/0362644 A1* | 12/2017 | Doudna ............... C12Q 1/6823 |

FOREIGN PATENT DOCUMENTS

| | | | |
|---|---|---|---|
| WO | 2014/018423 A2 | 1/2014 | |
| WO | 2014/093622 A2 | 6/2014 | |
| WO | 2016/205764 A9 | 12/2016 | |
| WO | WO 2016/196539 A2 * | 12/2016 | ............. A61K 48/00 |
| WO | 2017/219027 A1 | 12/2017 | |
| WO | 2018/035250 A1 | 2/2018 | |
| WO | 2019/005866 A1 | 1/2019 | |
| WO | 2019/010422 A1 | 1/2019 | |
| WO | 2020/006036 A1 | 1/2020 | |
| WO | 2020/006049 A1 | 1/2020 | |

OTHER PUBLICATIONS

Xu, et al., "Sequence Determinants of Improved CRISPR SgRNA Design", Genome Research, vol. 25, No. 8, Aug. 2015, 11 pages.
Yan, et al., "Cas13d Is a Compact RNA-Targeting Type VI CRISPR Effector Positively Modulated by a WYL-Domain-Containing Accessory Protein", Molecular Cell, vol. 70, No. 2, Apr. 19, 2018, 19 pages.
Zetsche, et al., "A Split-Cas9 Architecture for Inducible Genome Editing and Transcription Modulation", Nature Biotechnology, vol. 33, No. 2, Feb. 2015, 139-142.
Baserga, et al. "Distinct Molecular Signals for Nuclear Import of the Nucleolar snRNA, U3," Genes & Development, vol. 6, Mar. 1992, 1120-1130.
Mata, et al., "A Hexameric Phosphorothioate Oligonucleotide Telomerase Inhibitor Arrests Growth of Burkitt's Lymphoma Cells In Vitro and In Vivo," Toxicol Appl Pharmacol, vol. 144 (1) May 1996, abstract.
Milligan, et al., "An Anti-Parallel Triple Helix Motif with Oligodeoxynucleotides containing 2'-deoxyguanosine and 7-deaza-2'deoxyxanthosine," Nucleic Acids Research, vol. 21, No. 2, 1992, 327-333.
Chylinski, et al., "Classification and Evolution of Type II CRISPR-Cas Systems," Nucleic Acids Research, Information Retrieval Ltd., vol. 42, No. 10, Jun. 1, 2014, all enclosed pages cited.
Extended Search Report and Written Opinion of corresponding European application No. 18828493.9 mailed Apr. 15, 2021, all enclosed pages cited.
"International Preliminary Report on Patentability issued in International Application No. PCT/US2018/041099", mailed on Jan. 16, 2020, 7 pages.
"International Search Report and Written Opinion issued in International Application No. PCT/US2018/041099", mailed on Sep. 20, 2018, 10 pages.
Abudayyeh, et al., "C2C2 is a Single-Component Programmable RNA-Guided RNA-Targeting CRISPR Effector", Science, vol. 353, No. 6299, Aug. 5, 2016, 23 pages.
Balagaan, et al., "Stable and Efficient Intraocular Gene Transfer Using Pseudotyped EIAV Lentiviral Vectors", The Journal of Gene Medicine, vol. 8, Issue 3, Mar. 2006, 275-285.
Binley, et al., "Safety and Biodistribution of an Equine Infectious Anemia Virus-Based Gene Therapy, RetinoStat(®), for Age-Related Macular Degeneration", Human Gene Therapy, vol. 23, No. 9, Sep. 2012, 980-991.

Chen, et al., "Genome-Wide CRISPR Screen in a Mouse Model of Tumor Growth and Metastasis", Cell, vol. 160, No. 6, Mar. 12, 2015, 28 pages.
Cong, et al., "Multiplex Genome Engineering Using CRISPR/Cas Systems", Science, vol. 339, No. 6121, Feb. 15, 2013, 6 pages.
Digiusto, et al., "RNA-Based Gene Therapy for HIV with Lentiviral Vector-Modified CD34(+) Cells in Patients Undergoing Transplantation for AIDSrelated Lymphoma", Science Translational Medicine, vol. 2, Issue 36, Jun. 16, 2010, 8 pages.
Doench, et al., "Rational Design of Highly Active SgRNAs for CRISPR-Cas9-Mediated Gene Inactivation", Nature Biotechnology, vol. 32, No. 12, Dec. 2014, 17 pages.
East-Seletsky, et al., "Two Distinct RNase Activities of CRISPR-C2c2 Enable Guide-RNA Processing and RNA Detection", Nature, vol. 538, No. 7624, Oct. 13, 2016, 17 pages.
Eckstein, et al., "Insect-Related Differences in growth of Birch and Pine at Northern Treeline in Swedish Lapland", Holarctic Ecology, vol. 14, No. 1, 1991, 18-23.
Gao, et al., "Engineered Cpf1 Enzymes with Altered PAM Specificities", Nature Biotechnology, vol. 35, No. 8, Dec. 4, 2016, 17 pages.
Gootenberg, et al., "Nucleic Acid Detection with CRISPR-CAS13/C2C2", Science, vol. 356, No. 6336, Apr. 28, 2017, 12 pages.
Groenen, et al., "Nature of DNA Polymorphism in the Direct Repeat Cluster of *Mycobacterium tuberculosis*; Application for Strain Differentiation by a Novel Typing Method", Molecular Microbiology, vol. 10, No. 5, Jan. 1994 , 10 pages.
Hale, et al., "RNA-Guided RNA Cleavage by a CRISPR RNA-Cas Protein Complex", Cell, vol. 139, No. 5, Nov. 25, 2009, 945-956.
Hale, et al., "Target RNA Capture and Cleavage by the Cmr Type III-B CRISPR-Cas Effector Complex", Genes & Development, vol. 28, No. 21, Sep. 29, 2014, 13 pages.
Hoe, et al., "Rapid Molecular Genetic Subtyping of Serotype M1 Group A *Streptococcus* Strains", Emerging Infectious Diseases, vol. 5, No. 2, Mar.-Apr. 1999, 254-263.
Hsu, et al., "Development and Applications of CRISPR-Cas9 for Genome Engineering", Cell, vol. 157, No. 6, Jun. 5, 2014, 34 pages.
Hsu, et al., "DNA Targeting Specificity of Rna-Guided Cas9 Nucleases", Nature Biotechnology, vol. 31, No. 9, Sep. 2013, 8 pages.
Ishino, et al., "Nucleotide Sequence of the iap Gene, Responsible for Alkaline Phosphatase Isozyme Conversion in *Escherichia coli*, and Identification of the Gene Product", Journal of Bacteriology, vol. 169, No. 12, Dec. 1987, 5429-5433.
Jansen, et al., "Identification of a Novel Family of Sequence Repeats among Prokaryotes", OMICS: A Journal of Integrative Biology, vol. 6, No. 1, Feb. 2002 , 23-33.
Jansen, et al., "Identification of Genes that are Associated with DNA Repeats in Prokaryotes", Molecular Microbiology, vol. 43, Issue 6, Apr. 25, 2002, 1565-1575.
Jiang, et al., "RNA-Guided Editing of Bacterial Genomes Using CRISPR-Cas Systems", Nature Biotechnology, vol. 31, No. 3, Mar. 2013, 9 pages.
Konermann, et al., "Genome-Scale Transcriptional Activation by an Engineered CRISPR-Cas9 Complex", Nature, vol. 517, No. 7536, Dec. 10, 2014, 18 pages.
Konermann, et al., "Optical Control of Mammalian Endogenous Transcription and Epigenetic States", Nature, vol. 500, No. 7463, Aug. 22, 2013, 18 pages.
Lowder, et al., "A CRISPR/Cas9 Toolbox for Multiplexed Plant Genome Editing and Transcriptional Regulation", Plant Physiology, vol. 169, No. 2, Oct. 2015, 15 pages.
Masepohl, et al., "Long Tandemly Repeated Repetitive (LTRR) Sequences in the Filamentous Cyanobacterium *Anabaena* sp. PCC 7120", Biochimica et Biophysica Acta (BBA)—Gene Structure and Expression, vol. 1307, No. 1, Jun. 3, 1996, 26-30.
Mojica, et al., "Intervening Sequences of Regularly Spaced Prokaryotic Repeats Derive from Foreign Genetic Elements", Journal of Molecular Evolution, vol. 60, No. 2, Mar. 2005, 174-182.

(56) References Cited

OTHER PUBLICATIONS

Mojica, et al., "Long Stretches of Short Tandem Repeats Are Present in the Largest Replicons of the Archaea Haloferax Mediterranei and Haloferax Volcanii and Could Be Involved in Replicon Partitioning", Molecular Microbiology, vol. 17, No. 1, Jul. 1995, 85-93.

Mojica, et al., "MicroCorrespondence: Biological significance of a family of regularly spaced repeats in the genomes of Archaea, Bacteria and mitochondria", Molecular Microbiology, vol. 36, No. 1, Apr. 2000, 244-246.

Nakamura, et al., "Codon Usage Tabulated from the International DNA Sequence Databases: Status For the Year 2000", Nucleic Acids Research, vol. 28, No. 1, Jan. 1, 2000, 292 page.

Nakata, et al., "Unusual Nucleotide Arrangement with Repeated Sequences in the *Escherichia coli* K-12 Chromosome", Journal of Bacteriology, vol. 171, No. 6, Jun. 1989, 3553-3556.

Nishimasu, et al., "Crystal Structure of Cas9 in Complex with Guide RNA and Target DNA", Cell, vol. 156, No. 5, Feb. 27, 2014, 25 pages.

Nishimasu, et al., "Crystal Structure of *Staphylococcus aureus* Cas9", Cell, vol. 162, No. 5, Aug. 27, 2015, 24 pages.

Parnas, et al., "A Genome-Wide CRISPR Screen in Primary Immune Cells to Dissect Regulatory Networks", Cell, vol. 162, No. 3, Jul. 30, 2015, 24 pages.

Peng, et al., "An Archaeal CRISPR Type III-B System Exhibiting Distinctive RNA Targeting Features and Mediating Dual RNA and DNA Interference", Nucleic Acids Research, vol. 43, No. 1, Jan. 2015, 406-417.

Platt, et al., "CRISPR-Cas9 Knockin Mice for Genome Editing and Cancer Modeling", Cell, vol. 159, No. 2, Oct. 9, 2014, 31 pages.

Ramanan, et al., "CRISPR/Cas9 Cleavage of Viral DNA Efficiently Suppresses Hepatitis B Virus", Scientific Reports, vol. 5, No. 10833, Jun. 2, 2015, 9 pages.

Ran, et al., "Double Nicking by RNA-Guided CRISPR Cas9 for Enhanced Genome Editing Specificity", Cell, vol. 154, No. 6, Sep. 12, 2013, 19 pages.

Ran, et al., "Genome Engineering Using the CRISPR-Cas9 System", Nature Protocols, vol. 8, No. 11, Nov. 2013, 49 pages.

Ran, et al., "In Vivo Genome Editing using *Staphylococcus aureus* Cas9", Nature, vol. 520, No. 7546, Apr. 1, 2015, 30 pages.

Samai, et al., "Co-Transcriptional DNA and RNA Cleavage During Type III CRISPR-Cas Immunity", Cell, vol. 161, No. 5, May 21, 2015, 1164-1174.

Shalem, et al., "Genome-Scale CRISPR-Cas9 Knockout Screening in Human Cells", Science, vol. 343, No. 6166, Jan. 3, 2014, 10 pages.

Shalem, et al., "High-Throughput Functional Genomics Using CRISPR-Cas9", Nature Reviews Genetics, vol. 16, No. 5, May 2015, 28 pages.

Shmakov, et al., "Discovery and Functional Characterization of Diverse Class 2 CRISPR-Cas Systems", Molecular Cell, vol. 60, No. 3, Nov. 5, 2015, 23 pages.

Shmakov, et al., "Diversity and Evolution of Class 2 CRISPR-Cas Systems", Nature Reviews Microbiology, vol. 15, No. 3, Mar. 2017, 30 pages.

Smargon, et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 30 pages.

Strauss-Soukup, et al., "Effects of Neutralization Pattern and Stereochemistry on DNA Bending by Methylphosphonate Substitutions", Biochemistry, vol. 36, No. 29, Jul. 22, 1997, 8692-8698.

Swiech, et al., "In Vivo Interrogation of Gene Function in the Mammalian Brain Using CRISPR-Cas9", Nature Biotechnology, vol. 33, No. 1, Jan. 2015, 9 pages.

Van Embden, et al., "Genetic Variation and Evolutionary Origin of the Direct Repeat Locus of *Mycobacterium tuberculosis* Complex Bacteria", Journal of Bacteriology, vol. 182, No. 9, May 2000, 2393-2401.

Office Action of corresponding European application No. 18828493.9 mailed Apr. 15, 2021, all enclosed pages cited.

\* cited by examiner

Control, empty vector

Guide targeting L (#104)

CRISPR SYSTEM BASED ANTIVIRAL THERAPY

CROSS REFERENCE TO RELATED APPLICATIONS

This application is a national phase entry of International Application number PCT/US2018/041099 filed Jul. 6, 2018, which claims the benefit of U.S. Provisional Application No. 62/530,029 filed Jul. 7, 2017. The entire contents of the above-identified applications are hereby fully incorporated herein by reference.

STATEMENT REGARDING FEDERALLY SPONSORED RESEARCH

This invention was made with government support under grant numbers MH1007006, MH110049 and AI110818 awarded by the National Institutes of Health, and Grant No. D18AC00006 awarded by the Department of Defense. The government has certain rights in the invention.

REFERENCE TO AN ELECTRONIC SEQUENCE LISTING

The contents of the electronic sequence listing ("BROD_2810US_ST25.txt," 1,475,927 bytes, created on Jan. 22, 2020) is herein incorporated by reference in its entirety.

TECHNICAL FIELD

The subject matter disclosed herein is generally directed to the use of CRISPR effector systems for use in treating, preventing, suppressing, and/or alleviating viral pathogenesis, infection, propagation, and/or replication in a subject.

BACKGROUND

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important.

The CRISPR-Cas adaptive immune system defends microbes against foreign genetic elements via DNA or RNA-DNA interference. Recently, the Class 2 type VI single-component CRISPR-Cas effector Cas13a, previously known as C2c2 (Shmakov et al. (2015) "Discovery and Functional Characterization of Diverse Class 2 CRISPR-Cas Systems"; Molecular Cell 60:1-13; doi: dx.doi.org/10.1016/j.molcel.2015.10.008) was characterized as an RNA-guided Rnase (Abudayyeh et al. (2016), Science, [Epub ahead of print], June 2; "C2c2 is a single-component programmable RNA-guided RNA-targeting CRISPR effector"; doi: 10.1126/science.aaf5573). It was demonstrated that C2c2 (e.g. from *Leptotrichia shahii*) provides robust interference against RNA phage infection. Through in vitro biochemical analysis and in vivo assays, it was shown that C2c2 can be programmed to cleave ssRNA targets carrying protospacers flanked by a 3' H (non-G) PAM. Cleavage is mediated by catalytic residues in the two conserved HEPN domains of C2c2, mutations in which generate a catalytically inactive RNA-binding protein. C2c2 is guided by a single crRNA and can be re-programmed to deplete specific mRNAs in vivo. It was shown that LshC2c2 can be targeted to a specific site of interest and can carry out non-specific RNase activity once primed with the cognate target RNA. These results broaden our understanding of CRISPR-Cas systems and demonstrate the possibility of harnessing Cas13, such as Cas13a, Cas13b, or Cas13c to develop a broad set of RNA-targeting tools.

While interference with phage infection in prokaryotes has been demonstrated for LsCas13a, it is currently unknown if Cas13 mediated antiviral therapy is feasible or even possible at all in a eukaryotic setting. Indeed, the extreme differences between prokaryotes and eukaryotes, further confounded by the very nature of prokaryotic versus eukaryotic viruses, including etiology and pathogenesis, makes extrapolation from prokaryotic immunity to eukaryotic immunity highly unpredictable.

Citation or identification of any document in this application is not an admission that such document is available as prior art to the present invention.

SUMMARY

Antiviral drugs do not exist for most emerging viruses, and available direct-acting antivirals, which include small molecules, short interfering RNAs, and antibodies, typically target a small number of highly mutable viral proteins or RNAs. This is problematic because RNA viruses evolve rapidly and can easily acquire resistance to existing therapeutics. The present invention offers a new approach for highly multiplexed, programmable antiviral therapies that directly target viral RNA, and can be flexibly adapted to target novel viruses or emerging outbreak pathogens. Class 2, type VI CRISPR system-based therapies can be used in combination with existing antiviral compounds for viruses where such compounds exist, either by increasing their efficacy or by preventing the evolution of specific drug resistance mutations. Perhaps most excitingly, if a virus evolves resistance to a specific guide RNA sequence, it is easy to switch to a different guide RNA sequence, or design a new guide sequence to target the new mutation. Such approaches should prevent the widespread development of resistance to Class 2, type VI CRISPR system-based therapies.

Current gold-standard pathogen diagnostics are often expensive, slow, and lack sufficient sensitivity to detect viral infections. Standard molecular amplification methods, such as RT-qPCR, typically require nucleic acid extraction and expensive thermocycling machinery. Immunoassays, such as ELISAs, can only detect single targets, cross-react to antigenically similar targets, and cannot be quickly developed or updated to deal with new or evolving threats. By means of example, and without limitation, CRISPR-based detection/diagnostic platforms, such as described in Grootenberg et al. (2017), "Nucleic acid detection with CRISPR-Cas13/C2c2", Science, 356 (6336): 438-442 can transform the diagnosis of viral diseases with single-molecule detection sensitivity and single nucleotide polymorphism specificity.

The present inventors have surprisingly found that Class 2, type VI CRISPR systems are useful as an antiviral therapeutic or prophylactic.

The present invention has, among others, the following objectives: (1) Dissecting viral targets and viral evolution in response to anti-viral therapy, including Class 2, type VI CRISPR system therapy, to enable robust targeting. Methods and guides are identified which effectively inhibit viral pathogenesis, such as but not limited to viral replication. In certain embodiments, the guides are selected which reduce or avoid the evolution of viral resistance; (2) Multiplexed Class 2, type VI CRISPR system-based viral therapeutics to evade viral evolution; (3) Detecting viral mutations using, for example, Class 2, type VI CRISPR system-based diagnostics. This includes diagnostics that can detect novel mutations that arise in the course of therapy as well as mutations known to arise which lead to treatment resistance. Such diagnostics can be companion diagnostics to the therapeutic methods of the invention as described herein and can be used to select an initial anti-viral therapy and also to modify an anti-viral therapy in response to resistant mutants that may emerge.

In certain aspects, a Class 2, type VI CRISPR system-based diagnostic is used for disease surveillance before, during, or after the course of anti-viral therapy.

The present inventors have found that Class 2, type VI CRISPR systems, such as Cas13a, Cas13b, or Cas 13c have transformative potential as a tool for rapidly formulating antiviral therapeutics. Furthermore, Class 2, type VI CRISPR system-based therapies can be easily retargeted by changing the guide RNA sequences, which can help combatting the evolution of therapy resistance. Resistance mutations can also be rapidly, sensitively, and specifically detected, such as for instance, but not exclusively using the Cas13-based SHERLOCK platform (Grootenberg et al. (2017), "Nucleic acid detection with CRISPR-Cas13/C2c2", Science, 356 (6336): 438-442). This is a major improvement relative to existing approaches, which can take years to develop a single therapy for a single virus and are difficult to reformulate. Thus, the approaches according to the present invention enable the development of many new antiviral therapeutics. Moreover, this is an opportunity to learn basic information about how viruses evolve to evade treatment.

In certain aspects, the present invention relates to development of programmable, multiplexed viral therapeutics and sensitive viral diagnostics. In certain aspects, the invention relates to determining the rules for Class 2, type VI CRISPR effector targeting and analyzing viral evolution in response to Class 2, type VI CRISPR system targeting. In certain aspects, the invention relates to development of multiplexed Class 2, type VI CRISPR system-based therapies, such as to thwart viral evolution. In certain aspects, the invention relates to Class 2, type VI CRISPR system-based diagnostics, such as to detect viruses that could cause outbreaks and viral mutations that may occur during outbreaks.

Accordingly, in one aspect, the invention provides methods for treating, preventing, suppressing, and/or alleviating viral pathogenesis, infection, propagation, and/or replication in a subject, comprising administering to a subject in need thereof a Class 2, type VI CRISPR system comprising (a) a Class 2, type VI CRISPR effector protein and/or a polynucleic acid encoding said effector protein and (b) one or more guide RNAs and/or one or more polynucleic acids encoding said one or more guide RNAs designed to bind to one or more target molecules of a virus. In certain embodiments, viremia or viral load or titer is reduced or suppressed.

In another aspect, the invention relates to a Class 2, type VI CRISPR system comprising (a) a Class 2, type VI CRISPR effector protein and/or a polynucleic acid encoding said effector protein and (b) one or more guide RNAs and/or one or more polynucleic acids encoding said one or more guide RNAs designed to bind to one or more target molecules of a virus for use in treating, preventing, suppressing, and/or alleviating viral pathogenesis, infection, propagation and/or replication in a subject. In certain embodiments, viremia or viral load or titer is reduced or suppressed.

In a further aspect, the invention relates to a the use of Class 2, type VI CRISPR system comprising (a) a Class 2, type VI CRISPR effector protein and/or a polynucleic acid encoding said effector protein and (b) one or more guide RNAs and/or one or more polynucleic acids encoding said one or more guide RNAs designed to bind to one or more target molecules of a virus for the manufacture of a medicament for treating, preventing, suppressing, and/or alleviating viral pathogenesis, infection, propagation and/or replication in a subject. In certain embodiments, viremia or viral load or titer is reduced or suppressed.

To provide better surveillance of key viral mutations in nature, the present invention provides Class 2, type VI CRISPR system-based diagnostics for detecting viral mutations, variations, or polymorphisms, such as natural variations, or such as that may occur or have occurred during outbreaks. By means of example, and without limitation, a single nucleotide polymorphism in LCMV that is associated with the phenotypic switch between acute and persistent infection may be detected; the single nucleotide polymorphisms observed during an Ebola virus epidemic or a Zika virus epidemic may be detected, as well as the single nucleotide polymorphisms that are responsible for drug resistance in HIV may be detected. These tools enable to track viral evolution during future outbreaks, and better understand the role of adaptive mutations.

In a further aspect, the invention relates to methods for detecting a virus, in particular in vitro methods for detecting a virus. In a further aspect, the invention relates to methods for diagnosing a viral infection, in particular in vitro methods for diagnosing a viral infection. In a further aspect, the invention relates to methods for monitoring a viral infection, in particular in vitro methods for monitoring a viral infection. In a further aspect, the invention relates to methods for detecting or monitoring viral pathogenesis, infection, propagation and/or replication, in particular in vitro methods for detecting or monitoring viral pathogenesis, infection, propagation and/or replication. In a further aspect, the invention relates to methods for detecting or monitoring viral evolution, in particular in vitro methods for detecting or monitoring viral evolution. In a further aspect, the invention relates to methods for detecting or monitoring viral mutations or polymorphisms, in particular in vitro methods for detecting or monitoring viral mutations or polymorphisms. In a further aspect, the invention relates to methods for detecting or monitoring development or evolution of viral resistance such as resistance against the therapeutics of the invention, in particular in vitro methods for detecting or monitoring development or evolution of viral resistance, such as resistance to the therapeutics of the invention. In certain embodiments, these methods may involve CRISPR/Cas system based detection systems, such as described for instance in Gootenberg et al. (2017), "Nucleic acid detection with CRISPR-Cas13/C2c2", Science, 356 (6336): 438-442, which is incorporated herein by reference in its entirety. The methods are however not limited to such CRISPR/Cas system based detection systems. In certain embodiments, these methods are complementary diagnostic methods of the therapeutic methods of the invention. In certain embodiments, these methods are companion diagnostic methods of the therapeutic methods of the invention.

Given the high mutation rate of viruses, and in particular RNA viruses, monotherapy via individual guide RNAs may not completely inhibit viral pathogenesis, such as viral replication for extended periods of time. To determine the evolutionary response to Class 2, type VI CRISPR system-based therapy, in certain aspects, the invention relates to methods to determine if particular regions of the viral genome are more prone to evolving resistance to guide targeting regions of the viral genome. Based on such analysis, suitable gRNAs can be selected. Advantageously, to further minimize development of viral resistance, the invention in certain aspects relates to multiplexed approaches, in which multiple gRNAs are used to target particular viruses, particular strains, or particular viral variants. For instance, by using several guides, such as 2 or more, or 3 or more distinct guides, the evolution of resistance to Class 2, type VI CRISPR system-based therapies can be minimized. In the rare case that any resistance were to be observed, the guide RNA sequences being used could easily be switched. For instance, a guide specifically targeting the emerging resistance mutations can be designed or a guide targeting an entirely different region of the viral genome. Alternatively, if multiple guides are not sufficient to inhibit viral replication on their own, they can be used in combination with existing therapeutics.

The invention further relates to polynucleic acids, vectors, vector systems, compositions, such as pharmaceutical compositions, comprising Class 2, type VI CRISPR system comprising (a) a Class 2, type VI CRISPR effector protein and/or a polynucleic acid encoding said effector protein and (b) one or more guide RNAs and/or one or more polynucleic acids encoding said one or more guide RNAs designed to bind to one or more target molecules of a virus, and their use in or for treating, preventing, suppressing, and/or alleviating viral pathogenesis, infection, propagation and/or replication in a subject. The invention also relates to methods for treating, preventing, suppressing, and/or alleviating viral pathogenesis, infection, propagation and/or replication in a subject comprising administering such polynucleic acids, vectors, vector systems or compositions, as well as the use of such polynucleic acids, vectors, vector systems or compositions for the manufacture of a medicament for treating, preventing, suppressing, and/or alleviating viral pathogenesis, infection, propagation and/or replication in a subject. In certain embodiments, viremia or viral load or titer is reduced. An aspect of the invention is that the above elements are comprised in a single composition or comprised in individual compositions.

In certain embodiments, the effector protein and/or guide RNA are comprised in one or more polynucleic acid, such as a polynucleic acid encoding the effector protein and/or guide RNA. In certain embodiments, said polynucleic acid encoding said effector protein comprises a regulatory element operably linked to a polynucleic acid encoding said effector protein. In certain embodiments, said polynucleic acid encoding said one or more guide RNAs comprises a regulatory element operably linked to a polynucleic acid encoding said one or more guide RNAs. In certain embodiments, said polynucleic acid encoding said one or more guide RNAs and/or said effector protein are comprised in one or more vectors, preferably (eukaryotic) expression vectors. In certain embodiments, said vector is a viral vector. In certain embodiments, said viral vector is an adenoviral vector, an AAV vector, or a retroviral vector.

In certain embodiments, the effector protein and/or guide RNA are comprised in a polynucleic acid, preferably operably linked to a regulatory element, e.g. a promoter, such as a vector, wherein said effector protein and/or guide RNA are being expressed or are capable of being expressed constitutively or inducibly. In certain embodiments, the effector protein and/or guide RNA are comprised in a polynucleic acid, preferably operably linked to a regulatory element, e.g. a promoter, such as a vector, wherein said effector protein and/or guide RNA are being expressed or are capable of being expressed in a tissue specific manner.

In certain embodiments, the target molecule is, comprises, consists of, or consists essentially of a polynucleic acid. In certain embodiments, the target molecule is, comprises, consists of, or consists essentially of RNA. In certain embodiments, the target molecule is, comprises, consists of, or consists essentially of a viral target molecule. In certain embodiments, the target molecule is, comprises, consists of, or consists essentially of RNA. In certain embodiments, the target molecule is, comprises, consists of, or consists essentially of a viral RNA. In certain embodiments, the target molecule is, comprises, consists of, or consists essentially of RNA. In certain embodiments, the target molecule is, comprises, consists of, or consists essentially of a viral RNA transcribed from a viral DNA.

The subject may be a human or animal subject. In particular embodiments, the subject is a mammalian subject. The virus may thus be a human or animal virus. Alternatively, the virus may be a mammalian virus. The virus may be causative of human or animal disease. The virus may be causative of mammalian disease.

In certain embodiments, the virus is a plant virus.

In particular embodiments, the virus is an RNA virus. In further embodiments, the virus is a single stranded or double stranded RNA virus. In further embodiments, the virus is a positive sense RNA virus or a negative sense RNA virus or an ambisense RNA virus.

In certain embodiments, the one or more guide RNA binds to the coding strand of the RNA. In certain embodiments, the guide RNA binds to the non-coding strand of the RNA. In certain embodiments, the guide RNA binds to viral genomic RNA (positive or negative sense or coding or non-coding strand). In certain embodiments, the guide RNA binds to transcribed RNA (positive or negative sense or coding or non-coding strand) from viral genomic DNA or transcribed RNA from a provirus.

In further embodiments, the virus is a Retroviridae virus, Lentiviridae virus, Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus.

In particular embodiments, the virus is selected from the group consisting of Lymphocytic choriomeningitis virus, Coronavirus, HIV, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza and Hepatitis D virus.

In particular embodiments, the virus is a DNA virus. In further embodiments, the virus is a single stranded or double stranded DNA virus. In further embodiments, the virus is a positive sense DNA virus or a negative sense DNA virus or an ambisense DNA virus. In further embodiments, the virus is a Myoviridae, Podoviridae, Siphoviridae, Alloherpesviridae, Herpesviridae (including human herpes virus, and Varicella Zozter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, or Rhizidovirus.

In certain embodiments, the effector protein comprises one or more HEPN domains, preferablt two HEPN domains. In certain embodiments, the one or more HEPN domains comprises a RxxxxH motif sequence. In certain embodiments, the RxxxH motif comprises a R{N/H/K}X1X2X3H sequence, preferably wherein X1 is R, S, D, E, Q, N, G, or Y, and X2 is independently I, S, T, V, or L, and X3 is independently L, F, N, Y, V, I, S, D, E, or A.

In one example embodiment, the CRISPR system effector protein is a RNA-targeting effector protein. Example RNA-targeting effector proteins include Cas13b, Cas13c, and C2c2 (now known as Cas13a). It will be understood that the term "C2c2" herein is used interchangeably with "Cas13a". In another example embodiment, the RNA-targeting effector protein is Cas13a, Cas13b, or Cas 13c. In other embodiments, the C2c2 effector protein is from an organism of a genus selected from the group consisting of: Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter, and Lachnospira, or the C2c2 effector protein is an organism selected from the group consisting of: Leptotrichia shahii, Leptotrichia. wadei, Listeria seeligeri, Clostridium aminophilum, Carnobacterium gallinarum, Paludibacter propionicigenes, Listeria weihenstephanensis, or the C2c2 effector protein is a *L. wadei* F0279 or *L. wadei* F0279 (Lw2) C2C2 effector protein.

In certain embodiments, Cas13a is selected from Cas13a from an organism selected from the Cas13a effector protein is from an organism selected from the group consisting of: *Leptotrichia shahii; Leptotrichia wadei* (Lw2); *Listeria seeligeri*; Lachnospiraceae bacterium MA2020; Lachnospiraceae bacterium NK4A179; *Clostridium aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; *Eubacterium rectale*; Eubacteriaceae bacterium CHKCI004; *Blautia* sp. Marseille-P2398; and *Leptotrichia* sp. oral taxon 879 str. F0557, Lachnospiraceae bacterium NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; Porphyromonadaceae bacterium KH3CP3RA; *Listeria riparia*; and *Insolitispirillum peregrinum*.

In certain embodiments, the effector protein cleaves the target molecule. In certain embodiments, the effector molecule cleaves the target RNA. In certain embodiments, the effector protein comprises one or more mutations. In certain embodiments, the one or more mutations affect effector protein catalytic activity, stability, and/or specificity.

In certain embodiments, the effector protein is or comprises a fusion protein. In certain embodiments, the effector protein is a fusion protein with a heterologous domain. In certain embodiments, the effector protein comprises a nuclear localization signal (NLS) or a nuclear export signal (NES). In certain embodiments the effector protein comprises a heterologous nuclear localization signal (NLS) or a nuclear export signal (NES).

In certain embodiments, the effector protein is codon optimized. It will be understood that codon optimization may be species dependent.

In certain embodiments, the guide RNA comprises one or more, preferably one, mismatch with the target sequence. In certain embodiments, the guide RNA comprises one or more, preferably one, synthetic mismatch with the target sequence. In certain embodiments, said mismatch is up- or downstream of a SNP or other single nucleotide variation in said target molecule. In certain embodiments, the guide RNAs comprise a pan-viral guide RNA set that targets each virus and/or viral strain in a set of viruses.

In certain embodiments, more than one guide RNA is provided. In certain embodiments, the guide RNAs comprise a pan-viral guide RNA set that targets each virus and/or viral strain in a set of viruses. For instance, a panel of guide RNAs may be provided which collectively recognize different strains of a particular virus.

These and other aspects, objects, features, and advantages of the example embodiments will become apparent to those having ordinary skill in the art upon consideration of the following detailed description of illustrated example embodiments.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. All rights to explicitly disclaim any embodiments that are the subject of any granted patent(s) of applicant in the lineage of this application or in any other lineage or in any prior filed application of any third party is explicitly reserved. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

(FIG. 1A) Guide RNAs S1-S6 are complementary to the LCMV S RNA (of which S1 and S6 bind respectively to 5' UTR and 3'UTR). (FIG. 1B) Guide RNAs L1-L6 are complementary to the LCMV L RNA (of which L1 and L6 bind respectively to 5' UTR and 3'UTR). All guide RNAs bind to the coding strand.

FIG. 2—Cas13a and LCMV-specific guide RNA expression decreases LCMV replication in cell culture.

DETAILED DESCRIPTION OF THE INVENTION

Figure 1A:
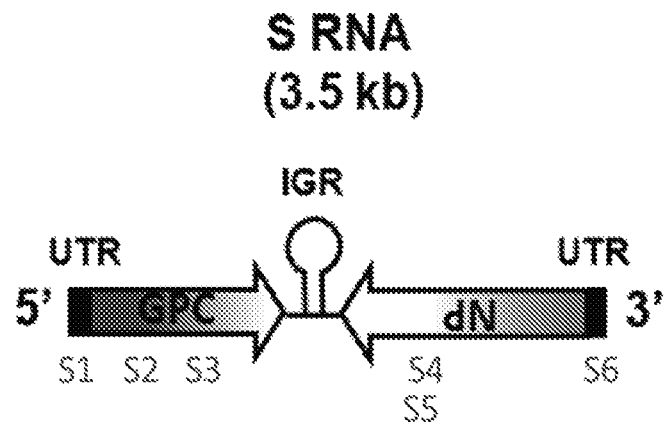
FIGS. 1A and 1B—Show location of designed guide RNAs along the segmented LCMV genome.

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboraotry Manual (1988) (Harlow and Lane, eds.): Antibodies A Laboraotry Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

Specific reference is made to U.S. Provisional Application No. 62/471,931 filed Mar. 15, 2017 and entitled "CRISPR Effector System Based Diagnostics" and U.S. Provisional Application No. 62/484,857 filed on Apr. 12, 2017 and entitled "CRISPR Effector System Based Diagnostics for Virus Detection."

All publications, published patent documents, and patent applications cited herein are hereby incorporated by reference to the same extent as though each individual publication, published patent document, or patent application was specifically and individually indicated as being incorporated by reference Microbial Clustered Regularly Interspaced Short Palindromic Repeats (CRISPR) and CRISPR-associated (CRISPR-Cas) adaptive immune systems contain programmable endonucleases, such as Cas9 and Cpf1 (Shmakov et al., 2017; Zetsche et al., 2015). Although both Cas9 and Cpf1 target DNA, single effector RNA-guided RNases have been recently discovered (Shmakov et al., 2015) and characterized (Abudayyeh et al., 2016; Smargon et al., 2017), including C2c2, providing a platform for specific RNA sensing. RNA-guided RNases can be easily and conveniently reprogrammed using CRISPR RNA (crRNAs) to cleave target RNAs.

In an aspect, the present invention relates to the use of the CRISPR system, in particular a Class 2, type VI CRISPR system, as an antiviral therapy or prophylactic (e.g. immunization), and/or as a viral diagnostic. The embodiments disclosed herein utilize RNA targeting effectors to treat and prevent infection by a viral pathogen in a subject. It has been found that RNA-targeting CRISPR proteins can be used to suppress different stages of infection of a eukaryotic cell by a virus. This implies that these CRISPR systems can be used to treat or prevent diseases caused by such viruses. This is of interest not only in human antiviral therapy, for diseases such as Ebola hemorrhoragic fever, SARS, hepatitis C, West Nile fever, polio and measles, but also for farm animals such as sheep and cows suffering from diseases such as Bovine viral diarrhea and Parainfluenza-3 virus-caused respiratory infections. In certain embodiments, the CRISPR systems according to the invention as described herein are used or can be used for immunization.

In one aspect, the embodiments disclosed herein are directed to methods for treating, preventing, suppressing, and/or alleviating infection, propagation, replication of and/or pathogenesis caused by a virus in a subject, comprising administering to a subject in need thereof a Class 2, type VI CRISPR system comprising an effector protein or a polynucleic acid encoding an effector protein and one or more guide RNAs or one or more polynucleic acids encoding one or more guide RNAs designed to bind to one or more target molecules of said virus. The polynucleic acid encoding said one or more guide RNAs and/or the effector protein may be comprised in one or more vector, which may be the same or different vectors, preferably (eukaryotic) expression vectors. Accordingly, the application provides a Class 2, type VI CRISPR system comprising an effector protein or a polynucleic acid encoding an effector protein and one or more guide RNAs or one or more polynucleic acids encoding one or more guide RNAs designed to bind to one or more target molecules of a virus for use in treating, preventing, suppressing, and/or alleviating infection, propagation, replication of and/or pathogenesis caused by a virus in a subject. Also, the invention provides pharmaceutical compositions comprising the CRISPR system as defined herein, for use in treating, preventing, suppressing, and/or alleviating infection, propagation, replication of and/or pathogenesis caused by a virus in a subject.

In an aspect, the invention provides methods and compositions for modulating, e.g., reducing, (protein) expression of a (viral) target RNA in cells. In the subject methods, a CRISPR system of the invention is provided that interferes with transcription, stability, and/or translation of an RNA.

In certain embodiments, an effective amount of CRISPR system is used to cleave RNA or otherwise inhibit RNA expression. In this regard, the system has uses similar to siRNA and shRNA, thus can also be substituted for such methods. The method includes, without limitation, use of a CRISPR system as a substitute for e.g., an interfering ribonucleic acid (such as an siRNA or shRNA) or a transcription template thereof, e.g., a DNA encoding an shRNA. The CRISPR system is introduced into a target cell, e.g., by being administered to a mammal that includes the target cell, Advantageously, a CRISPR system of the invention is specific. For example, whereas interfering ribonucleic acid (such as an siRNA or shRNA) polynucleotide systems are plagued by design and stability issues and off-target binding, a CRISPR system of the invention can be designed with high specificity.

In certain embodiments, the systems, compositions, polynucleic acids, vector and vector systems, and methods, disclosed herein are useful for diagnosing and/or treating viral pathogenesis, infection, propagation, and/or replication in a subject. In certain embodiments, the systems, compositions, polynucleic acids, vector and vector systems, and methods, disclosed herein are useful for preventing viral pathogenesis, infection, propagation, and/or replication in a subject. In certain embodiments, the systems, compositions, polynucleic acids, vector and vector systems, and methods, disclosed herein are useful for suppressing viral pathogenesis, infection, propagation, and/or replication in a subject. In certain embodiments, the systems, compositions, polynucleic acids, vector and vector systems, and methods, disclosed herein are useful for alleviating viral pathogenesis, infection, propagation, and/or replication in a subject. In certain example embodiments, the systems, compositions, polynucleic acids, vector and vector systems, and methods, disclosed herein are useful for immunization against a virus. In certain example embodiments, the systems, compositions, polynucleic acids, vector and vector systems, and methods, disclosed herein are useful for suppressing or alleviating viremia or reducing viral load or titer in a subject. In certain embodiments, the systems, compositions, polynucleic acids, vector and vector systems, and methods, disclosed herein are useful for treating viral pathogenesis in a subject. In certain embodiments, the systems, compositions, polynucleic acids, vector and vector systems, and methods, disclosed herein are useful for preventing viral pathogenesis in a subject. In certain embodiments, the systems, compositions, polynucleic acids, vector and vector systems, and methods, disclosed herein are useful for suppressing viral pathogenesis in a subject. In certain embodiments, the systems, compositions, polynucleic acids, vector and vector systems, and methods, disclosed herein are useful for alleviating viral pathogenesis in a subject. In certain embodiments, the systems, compositions, polynucleic acids, vector and vector systems, and methods, disclosed herein are useful for treating viral infection in a subject. In certain embodiments, the systems, compositions, polynucleic acids, vector and vector systems, and methods, disclosed herein are useful for preventing viral infection in a subject. In certain embodiments, the systems, compositions, polynucleic acids, vector and vector systems, and methods, disclosed herein are useful for suppressing viral infection in a subject. In certain embodiments, the systems, compositions, polynucleic acids, vector and vector systems, and methods, disclosed herein are useful for alleviating viral infection in a subject. In certain embodiments, the systems, compositions, polynucleic acids, vector and vector systems, and methods, disclosed herein are useful for treating viral propagation in a subject. In certain embodiments, the systems, compositions, polynucleic acids, vector and vector systems, and methods, disclosed herein are useful for preventing viral propagation in a subject. In certain embodiments, the systems, compositions, polynucleic acids, vector and vector systems, and methods, disclosed herein are useful for suppressing viral propagation in a subject. In certain embodiments, the systems, compositions, polynucleic acids, vector and vector systems, and methods, disclosed herein are useful for alleviating or reducing viral propagation in a subject. In certain embodiments, the systems, compositions, polynucleic acids, vector and vector systems, and methods, disclosed herein are useful for treating viral replication in a subject. In certain embodiments, the systems, compositions, polynucleic acids, vector and vector systems, and methods, disclosed herein are useful for preventing viral replication in a subject. In certain embodiments, the systems, compositions, polynucleic acids, vector and vector systems, and methods, disclosed herein are useful for suppressing viral replication in a subject. In certain embodiments, the systems, compositions, polynucleic acids, vector and vector systems, and methods, disclosed herein are useful for alleviating or reducing viral replication in a subject.

In certain embodiments, the virus is a pathogenic virus. In certain embodiments, the virus is an opportunistic pathogenic virus. In certain embodiments, the virus is causative of a disease, preferably in a human or animal subject, such as a mammalian subject. In certain embodiments, the virus may cause acute disease (e.g. in human or animal or in mammal). In certain embodiments, the virus may cause chronic disease (e.g. in human or animal or in mammal). In certain embodiments, the virus may be dormant or in a dormant state. In certain embodiments, the virus may be latent or in latency or a latent state. In certain embodiments, the virus may be lysogenic or in a lysogenic state. In certain embodiments, the virus may be lytic or in a lytic state. In certain embodiments, the virus may be a provirus. In certain embodiments the virus may be episomal. In certain embodiments, the virus may be a latent provirus. In certain embodiments, the virus may be a latent episomal virus.

In certain embodiments, the systems, compositions, polynucleic acids, vector and vector systems, and methods, disclosed herein are useful for inducing or maintaining viral latency or dormancy. In certain embodiments, the systems, compositions, polynucleic acids, vector and vector systems, and methods, disclosed herein are useful for preventing or reducing viral activation and/or viral shedding.

In certain example embodiments, the systems, compositions, polynucleic acids, vector and vector systems, and methods, disclosed herein are useful for treating, preventing, suppressing, and/or alleviating viral pathogenesis, infection, propagation, and/or replication in a subject, or for immunization, or for reducing viremia or viral load or titer in a subject. In certain example embodiments, the systems, compositions, polynucleic acids, vector and vector systems, and methods, disclosed herein are useful for diagnosing a virus. The virus may be a DNA virus (single or double stranded, positive or negative sense or ambisense) or an RNA virus (single or double stranded, positive or negative sense or ambisense). In certain embodiments, the virus is Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the virus may be a human respiratory syncytial virus, Sudan ebola virus, Bundibugyo virus, Tai Forest ebola virus, Reston ebola virus, Achimota, Aedes flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyoxivirus, Australian bat lyssavirus, Avian bornavirus, Avian metapneumovirus, Avian paramyoxviruses, penguin or Falkland Islandsvirus, BK polyomavirus, Bagaza virus, Banna virus, Bat hepevirus, Bat sapovirus, Bear Canon mammarenavirus, Beilong virus, Betacoronoavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwere virus, Caliciviridae virus. California encephalitis virus, Candiru virus, Canine distemper virus, Canaine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, Culex flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyoxvirus, Fitzroy River virus, Flaviviridae virus, Flexal mammarenavirus, GB virus C, Gairo virus, Gemycircularvirus, Goose paramyoxiviurs SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human gential-associated circular DNA virus-1, Human herpesvirus 1-8, Human immunodeficiency virus 1/2, Huan mastadenovirus A-G, Human papillomavirus, Human parainfluenza virus 1-4, Human paraechovirus, Human picobirnavirus, Human smacovirus, Ikoma lyssavirus, Ilheus virus, Influenza A-C, Ippy mammarenavirus, Irkut virus, J-virus, JC polyomavirus, Japanses encephalitis virus, Junin mammarenavirus, KI polyomavirus, Kadipiro virus, Kamiti River virus, Kedougou virus, Khujand virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\0.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, Montana myotis leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Procine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno canis virus, Torque teno douroucouli virus, Torque teno felis virus, Torque teno midi virus, Torque teno sus virus, Torque teno tamarin virus, Torque teno virus, Torque teno zalophus virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or Zygosaccharomyces bailii virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain embodiments, the virus is a virus listed in Table 1 below, or a virus of the indicated genus/family.

TABLE 1

| Virus | Genus, Family | Host | Transmission | Disease |
|---|---|---|---|---|
| Adeno-associated virus | *Dependovirus* | Human, vertebrates | Respiratory | None |
| Aichi virus | *Kobuvirus, Picornaviridae* | Human | Fecal-oral | Gastroenteritis |
| Australian bat lyssavirus | *Lyssavirus, Rhabdoviridae* | Human, bats | Zoonosis, animal bite | Fatal encephalitis |
| BK polyomavirus | *Polyomavirus, Polyomaviridae* | Human | Respiratory fluids or urine | None |
| Banna virus | *Seadornavirus, Reoviridae* | Human, cattle, pig, mosquitoes | Zoonosis, arthropod bite | Encephalitis |
| Barmah forest virus | *Alphavirus, Togaviridae* | Human, marsupials, mosquitoes | Zoonosis, arthropod bite | Fever, joint pain |
| Bunyamwera virus | *Orthobunyavirus, Bunvaviridae* | Human, mosquitoes | Zoonosis, arthropod bite | Encephalitis |
| Bunyavirus La Crosse | *Orthobunyavirus, Bunyaviridae* | Human, deer, mosquitoes, tamias | Zoonosis, arthropod bite | Encephalitis |
| Bunyavirus snowshoe hare | *Orthobunyavirus, Bunyaviridae* | Human, rodents, mosquitoes | Zoonosis, arthropod bite | Encephalitis |
| Cercopithecine herpesvirus | *Lymphocryptovirus, Herpesviridae* | Human, monkeys | Zoonosis, animal bite | Encephalitis |
| Chandipura virus | *Vesiculovirus, Rhabdoviridae* | Human, sandflies | Zoonosis, athropod bite | Encephalitis |
| Chikungunya virus | *Alphavirus, Togaviridae* | Human, monkeys, mosquitoes | Zoonosis, arthropod bite | Fever, joint pain |
| Cosavirus A | *Cosavirus, Picornaviridae* | Human | Fecal-oral (probable) | — |
| Cowpox virus | *Orthopoxvirus, Poxviridae* | Human, mammals | Zoonosis, contact | None |
| Coxsackievirus | *Entcrovirus, Picornaviridae* | Human | Fecal-oral | Meningitis, myocarditis, paralysis |
| Crimean-Congo hemorrhagic fever virus | *Nairovirus, Bunyaviridae* | Human, vertebrates, ticks | Zoonosis, arthropod bite | Hemorrhagic fever |
| Dengue virus | *Flavivirus, Flaviviridae* | Human, mosquitoes | Zoonosis, arthropod bite | Hemorrhagic fever |
| Dhori virus | *Thogotovirus, Orthomyxoviridae* | Human, ticks | Zoonosis, arthropod bite | Fever, encephalitis |
| Dugbe virus | *Nairovirus, Bunyaviridae* | Human, ticks | Zoonosis, arthropod bite | Thrombocytopaenia |
| Duvenhage virus | *Lyssavirus, Rhabdoviridae* | Human, mammals | Zoonosis, animal bite | Fatal encephalitis |

TABLE 1-continued

| Virus | Genus, Family | Host | Transmission | Disease |
|---|---|---|---|---|
| Eastern equine encephalitis virus | *Alphavirus, Togaviridae* | Human, birds, mosquitoes | Zoonosis, arthropod bite | Encephalitis |
| Ebolavirus | *Ebolavirus, Filoviridae* | Human, monkeys, bats | Zoonosis, contact | Hemorrhagic fever |
| Echovirus | *Enterovirus, Picornaviridae* | Human | Fecal-oral | Common cold |
| Encephalomyocar ditis virus | *Cardiovirus, Picornaviridae* | Human, mouse, rat, pig | Zoonosis | Encephalitis |
| Epstein-Barr virus | *Lymphocryptovirus, Herpesviridae* | Human | Contact, saliva | Mononucleosis |
| European bat lyssavirus | *Lyssavirus, Rhabdovirus* | Human, bats | Zoonosis, animal bite | Fatal encephalitis |
| GB virus C/Hepatitis G virus | *Pegivirus, Flaviviridae* | Human | Blood, occasionally sexual | None |
| Hantaan virus | *Hantavirus, Bunyaviridae* | Human, rodents | Zoonosis, urine, saliva | Renal or respiratory svndrome |
| Hendra virus | *Henipavirus, paramyxoviridae* | Human, horse, bats | Zoonosis, animal bite | Encephalitis |
| Hepatitis A virus | *Hepatovirus, picornaviridae* | Human | Fecal-oral | Hepatitis |
| Hepatitis B virus | *Orthohepadnavirus, Hepadnaviridae* | Human, Chimpanzees | Sexual contact, blood | Hepatitis |
| Hepatitis C virus | *Hepacivirus, Flaviviridae* | Human | Sexual, blood | Hepatitis |
| Hepatitis E virus | *Hepevirus, Unassigned* | Human, pig, monkeys, some rodents, chicken | Zoonosis, food | Hepatitis |
| Hepatitis delta virus | *Deltavirus, Unassigned* | Human | Sexual contact, blood | Hepatitis |
| Horsepox virus | *Orthopoxvirus, Poxviridae* | Human, horses | Zoonosis, contact | None |
| Human adenovirus | *Mastadenovirus, Adenoviridae* | Human | Respiratory, fecal-oral | Respiratory |
| Human astrovirus | *Mamastrovirus, Astroviridae* | Human | Fecal-oral | Gastroenteritis |
| Human coronavirus | *Alphacoronavirus, Coronaviridae* | Human | Respiratory | Respiratory |
| Human cytomegalovirus | *Cytomegalovirus, Herpesviridae* | Human | Contact, urine, saliva | Mononucleosis, pneumonia |
| Human enterovirus 68, 70 | *Enterovirus, Picornaviridae* | Human | Fecal-oral | Diarrhea, neurological disorder |
| Human herpesvirus 1 | *Simplexvirus, Herpesviridae* | Human | Sexual contact, saliva | Skin lesions |
| Human herpesvirus 2 | *Simplexvirus, Herpesviridae* | Human | Sexual contact, saliva | Skin lesions |
| Human herpesvirus 6 | *Roseolovirus, Herpesviridae* | Human | Respiratory, contact | Skin lesions |
| Human herpesvirus 7 | *Roseolovirus, Herpesviridae* | Human | Respiratory, contact | Skin lesions |
| Human herpesvirus 8 | *Rhadinovirus, Herpesviridae* | Human | Sexual contact, saliva | Skin lymphoma |
| Human immunodeficiency virus | *Lentivirus, Retroviridae* | Human | Sexual contact, blood | AIDS |
| Human papillomavirus 1 | *Mupapillomavirus, Papillomaviridae* | Human | Contact | Skin warts |
| Human papillomavirus 2 | *Alphapapillomavirus, Papillomaviridae* | Human | Contact | Skin warts |
| Human papillomavirus 16,18 | *Alphapapillomavirus, Papillomaviridae* | Human | Sexual | Genital warts, cervical cancer |
| Human parainfluenza | *Respirovirus, Paramyxoviridae* | Human | Respiratory | Respiratory |
| Human parvovirus B19 | *Erythrovirus, Parvoviridae* | Human | Respiratory | Skin lesion |
| Human respiratory syncytial virus | *Pneumovirus, Paramyxoviridae* | Human | Respiratory | Respiratory |
| Human rhinovirus | *Enterovirus* | Human | Respiratory | Respiratory |
| Human SARS coronavirus | *Betacoronavirus, Coronaviridae* | Human, palm civet | Zoonosis | Respiratory |
| Human spumaretrovirus | *Spumavirus, Retroviridae* | Human | Contact, saliva | None |
| Human T-lymphotropic virus | *Deltaretrovirus, Retroviridae* | Human | Sexual contact, maternal-neonatal | Leukemia |
| Human torovirus | *Torovirus, Coronaviridae* | Human | Fecal-oral | Gastroenteritis |
| Influenza A virus | *Influenzavirus A, Orthomyxoviridae* | Human, birds, pigs | Respiratory or Zoonosis, animal contact | Flu |
| Influenza B virus | *Influenzavirus B, Orthomyxoviridae* | Human | Respiratory | Flu |
| Influenza C virus | *Influenzavirus C, Orthomyxoviridae* | Human | Respiratory | Flu |
| Isfahan virus | *Vesiculovirus, Rhabdoviridae* | Human, sandflies, gerbils | Zoonosis, arthropod bite | Undocumented, encephalitis |
| JC polyomavirus | *Polyomavirus, Polvomaviridae* | Human | Fecal-oral or urine | Encephalitis |
| Japanese encephalitis virus | *Flavivirus, Flaviviridae* | Human, horses, birds, mosquitoes | Zoonosis, arthropod borne | Encephalitis |
| Junin arenavirus | *Arenavirus, Arenaviridae* | Human, rodents | Zoonosis, fomite | Hemorrhagic fever |
| KI Polyomavirus | *Polyomavirus, Polyomaviridae* | Human | Fecal-oral or urine | Encephalitis |
| Kunjin virus | *Flavivirus, Flaviviridae* | Human, horses, birds, mosquitoes | Zoonosis, arthropod borne | Encephalitis |
| Lagos bat virus | *Lyssavirus, Rhabdoviridae* | Human, mammals | Zoonosis, animal bite | Fatal encephalitis |
| Lake Victoria marburgvirus | *Marburgvirus, Filoviridae* | Human, monkeys, bats | Zoonosis, fomite | Hemorrhagic fever |
| Langat virus | *Flavivirus, Flaviviridae* | Human, ticks | Zoonosis, arthropod borne | Encephalitis |
| Lassa virus | *Arenavirus, Arenaviridae* | Human, rats | Zoonosis, fomites | Hemorrhagic fever |
| Lordsdale virus | *Norovirus, Caliciviridae* | Human | Fecal-oral | Gastroenteritis |
| Louping ill virus | *Flavivirus, Flaviviridae* | Human, mammals, ticks | Zoonosis, arthropod bite | Encephalitis |
| Lymphocytic choriomeningitis virus | *Arenavirus, Arenaviridae* | Human, rodents | Zoonosis, fomite | Encephalitis |
| Machupo virus | *Arenavirus, Arenaviridae* | Human, monkeys, mouse | Zoonosis, fomite | Encephalitis |
| Mayaro virus | *Alphavirus, Togaviridae* | Human, mosquitoes | Zoonosis, arthropod bite | Fever, joint pain |
| MERS coronavirus | *Betacoronavirus, Coronaviridae* | Human, Tomb bat | Zoonosis | Respiratory |

TABLE 1-continued

| Virus | Genus, Family | Host | Transmission | Disease |
|---|---|---|---|---|
| Measles virus | Morbilivirus, Paramyxoviridae | Human | Respirator, | Fever, rash |
| Mengo encephalomyocarditis virus | Cardiovirus, Picornaviridae | Human, mouse, rabbit | Zoonosis | Encephalitis |
| Merkel cell polyomavirus | Polyomavirus, Polyomaviridae | Human | — | Merkel cell carcinoma |
| Mokola virus | Lyssavirus, Rhabdoviridae | Human, rodents, cat, dog shrew | Zoonosis, animal bite | Encephalitis |
| Molluscum contagiosum virus | Molluscipoxvirus, Poxviridae | Human | Contact | Skin lesions |
| Monkeypox virus | Orthopoxvirus | Human, mouse, prairie dog | Zoonosis, contact | Skin lesions |
| Mumps virus | Rubulavirus, Paramyxoviridae | Human | Respiratory, saliva | Mumps |
| Murray valley encephalitis virus | Flavivirus | Human, mosquitoes | Zoonosis, arthropod bite | Encephalitis |
| New York virus | Hantavirus, Bunyavirus | Human, mouse | Zoonosis, urine, saliva | Hemorrhagic fever |
| Nipah virus | Henipavirus, Paramyxoviridae | Human, bats | Zoonosis, animal bite | Encephalitis |
| Norwalk virus | Norovirus, Caliciviridae | Human | Fecal-oral | Gastroenteritis |
| O'nyong-nyong virus | Alphavirus, Togaviridae | Human, mosquitoes | Zoonosis, arthropod bite | Fever, joint pain |
| Orf virus | Parapoxvirus, Poxviridae | Human, mammals | Zoonosis, contact | Skin lesions |
| Oropouche virus | Orthobunyavirus | Human, wild animals(sloths) | Zoonosis, arthropod bite | Fever, joint pain |
| Pichinde virus | Arenavirus, Arenaviridae | Human, rat, guinea pig | Zoonosis, fomite | Hemorrhagic fever |
| Poliovirus | Enterovirus, Picornaviridae | Human, mammals | Fecal-oral | Poliomyelitis |
| Punta toro phlebovirus | Phlebovirus, Bunyaviridae | Human, sandflies | Zoonosis, arthropod bite | Hemorrhagic fever |
| Puumala virus | Hantavirus, Bunyavirus | Human, bank vole | Zoonosis, urine, saliva | Hemorrhagic fever |
| Rabies virus | Lyssavirus, Rhabdoviridae | Human, mammals | Zoonosis, animal bite | Fatal encephalitis |
| Rift valley fever virus | Phlebovirus, Bunvaviridae | Human, mammals, mosquitoes, sandflies | Zoonosis, arthropod bite | Hemorrhagic fever |
| Rosavirus A | Rosavirus, Picornaviridae | Human | | |
| Ross river virus | Alphavirus, Togaviridae | Human, mosquitoes, marsupials | Zoonosis, arthropod bite | Fever, joint pain |
| Virus | Genus, Family | Host | Transmission | Disease |
| Rotavirus A | Rotavirus, Rcoviridae | Human | Fecal-oral | Gastroenteritis |
| Rotavirus B | Rotavirus, Rcoviridae | Human | Fecal-oral | Gastroenteritis |
| Rotavirus C | Rotavirus, Rcoviridae | Human | Fecal-oral | Gastroenteritis |
| Rubella virus | Rubivirus, Togaviridae | Human | Respiratory | Rubella |
| Sagiyama virus | Alphavirus, Togaviridae | Human, horse, pig, mosquitoes | Zoonosis, arthropod bite | Fever, joint pain |
| Salivirus A | Salivirus, Picornaviridae | Human | | Gastroenteritis |
| Sandfly fever sicilian virus | Phlebovirus, Bunyaviridae | Human, sandflies | Zoonosis, arthropod bite | Hemorrhagic fever |
| Sapporo virus | Sapovirus, Caliciviridae | Human | Fecal-oral | Gastroenteritis |
| Semliki forest virus | Alphavirus, Togaviridae | Human, birds, hedgehog, mosquitoes | Zoonosis, arthropod bite | Fever, joint pain |
| Seoul virus | Hantavirus, Bunyavirus | Human, rats | Zoonosis, urine, saliva | Hemorrhagic fever |
| Simian foamy virus | Spumavirus, Retroviridae | Human, monkeys | Zoonosis, contact | None |
| Simian virus 5 | Rubulavirus, Paramyxoviridae | Human, dog | Zoonosis, contact | Undocumented |
| Sindbis virus | Alphavirus, Togaviridae | Human, birds, mosquitoes | Zoonosis, arthropod bite | Pogosta_disease Fever, joint pain |
| Southampton virus | Norovirus, Caliciviridae | Human | Fecal-oral | Gastroenteritis |
| St. louis encephalitis virus | Flavivirus, Flaviviridae | Human, birds, mosquitoes | Zoonosis, arthropod bite | Encephalitis |
| Tick-borne powassan virus | Flavivirus, Flaviviridae | Human, ticks | Zoonosis, arthropod bite | Encephalitis |
| Torque teno virus | Alphatorquevirus | Human | Sexual, blood | None |
| Toscana virus | Phlebovirus, Bunyaviridae | Human, mosquitoes | Zoonosis, arthropod bite | Hemorrhagic fever |
| Uukuniemi virus | Phleboviris, Bunyaviridae | Human, ticks | Zoonosis, arthropod bite | Hemorrhagic fever |
| Vaccinia virus | Orthopoxvirus, Poxviridae | Human, mammals | Contact | None |
| Varicella-zoster virus | Varicellovirus, Herpesviridae | Human | Respiratory, contact | Varicella |
| Variola virus | Orthopoxvirus, Poxviridae | Human | Respiratory | Variola |
| Venezuelan equine encephalitis virus | Alphavirus, Togaviridae | Human, rodents, mosquitoes | Zoonosis, arthropod bite | Fever, joint pain |
| Vesicular stomatitis virus | Vesiculovirus, Rhabdoviridae | Human, cattle, horse, pig, flies | Zoonosis, athropod bite | Encephalitis |
| Western equine encephalitis virus | Alphavirus, Togaviridae | Human, vertebrates, mosquitoes | Zoonosis, arthropod bite | Fever, joint pain |
| WU polyomavirus | Polyomavirus, Polyomaviridae | Human | Respiratory fluids or urine | None |
| West Nile virus | Flavivirus, Flaviviridae | Human, birds, ticks, mosquitoes | Zoonosis, arthropod bite | Hemorrhagic fever |
| Yaba monkey tumor virus | Orthopoxvirus, Poxviridae | Human, monkeys | Zoonosis, contact | None |
| Yaba-like disease virus | Orthopoxvirus, Poxviridae | Human, monkeys | Zoonosis, contact | None |
| Yellow fever virus | Flavivirus, Flaviviridae | Human, monkeys, mosquitoes | Zoonosis, arthropod bite | Hemorrhagic fever |
| Zika virus | Flavivirus, Flaviviridae | Human, monkeys, mosauitoes | Zoonosis, arthropod bite | Fever, joint pain, rash |

In certain embodiments, the virus is a virus listed in Table 2 below. The type of delivery will be dependent upon the tissue/cell tropism of the RNA (or DNA) virus of interest. Accordingly, in certain embodiments, the virus is a virus listed in Table 2 below and the delivery vehicle is suitable for delivery to the cells or tissues or organs (corresponding to the indicated virus) listed in Table 2 below.

TABLE 2

| Virus | Tissue/cell type | Citation |
|---|---|---|
| Lassa virus | DCs, vascular endothelial cells | Kunz, S. et. al. 2005. *Journal of Virology* |
| Ebola virus | Numerous (DCs, macrophages, hepatocytes, etc.) | Martines, R.B. et. al. 2015. *Journal of Pathology.* |

TABLE 2-continued

| Virus | Tissue/cell type | Citation |
|---|---|---|
| SARS-CoV | Lung | To, KF. et. al. 2004. *Journal of Pathology*. |
| Zika | Numerous (bodily fluids, placenta, brain, etc.) | Miner, J.J. & Diamond, M.S. 2017. *Cell Host & Microbe*. |
| Dengue | Numerous (DCs, macrophages, liver, etc.) | Flipse, J. et. al. 2016. *Journal of General Virology*. |
| Chikungunya | Numerous (immune cells, liver, central nervous system, etc.) | Schwartz, O. & Albert, M.L. 2010. *Nature Reviews*. |
| Influenza | Lung epithelial cells or macrophages | Medina, R.A. & Garcia-Sastre A. 2011 *Nature Reviews*. |
| HIV | T cells, macrophages | Weiss, R.A. 2002. *IUBMB Life*. |
| Rotavirus | Intestine | Lopez, S & Arias, C.F. 2006. *CTMI* |
| Herpes Simplex (HSV-1) | Epithelial cells, neuronal cells | Schelhaas, M. et. al. 2003. *Journal of General Virology*. |
| HCV | Liver | Ding, Q. et. al. 2014. *Cell Host & Microbe*. |
| HBV | Liver | Schieck, A. et. al. 2013. *Hepatology*. |

In certain embodiments, the virus is a virus listed in Table 3 below.

TABLE 3

| List of Viruses with FDA-Approved Vaccines (15-16): |
|---|
| 1. Adenovirus |
| 2. Hepatitis A |
| 3. Hepatitis B |
| 4. Human Papillomavirus (HPV) |
| 5. Influenza |
| 6. Japanese Encephalitis Virus |
| 7. Measles |
| 8. Mumps |
| 9. Polio |
| 10. Rabies |
| 11. Rotavirus |
| 12. Rubella |
| 13. Shingles/Zoster (HSV) |
| 14. Smallpox* |
| 15. Varicella (Chicken Pox) |
| 16. Yellow Fever |
| List of Viruses with FDA-Approved Antiviral Drugs (9): |
| 1. Cytomegalovirus |
| 2. Human Immunodeficiency Virus (HIV) |
| 3. Hepatitis B |
| 4. Hepatitis C |
| 5. Influenza |
| 6. Respiratory Syncytial Virus |
| 7. Human Papillomavirus (HPV) |
| 8. Herpes Simplex Virus (Shingles) |
| 9. Varicella Zoster Virus (Chicken pox) |
| List of Viruses with FDA-Approved Nucleic Acid Diagnostics (11): |
| 1. Adenovirus |
| 2. Cytomegalovirus |
| 3. Dengue |
| 4. Enterovirus |
| 5. Herpes Simplex Virus |
| 6. Hepatitis B |
| 7. Hepatitis C |
| 8. Human Metapneumovirus |
| 9. Human Papillomavirus |
| 10. Influenza |
| 11. Respiratory Syncytial Virus |

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), Arabis mosaic virus (ArMV), or Rupestris stem pitting-associated virus (RSPaV).

In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zozter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others.

In certain embodiments, the virus is a drug resistant virus. By means of example, and without limitation, the virus may be a ribavirin resistant virus. Ribavirin is a very effective antiviral that hits a number of RNA viruses. Below are a few important viruses that have evolved ribavirin resistance. Foot and Mouth Disease Virus: doi:10.1128/JVI.03594-13. Polio virus: pnas.org/content/100/12/7289.full.pdf. Hepatitis C Virus: jvi.asm.org/content/79/4/2346.full. A number of other persistent RNA viruses, such as hepatitis and HIV, have evolved resistance to existing antiviral drugs. Hepatitis B Virus (lamivudine, tenofovir, entecavir): doi:10.1002/hep.22900. Hepatitis C Virus (Telaprevir, BILN2061, ITMN-191, SCH6, Boceprevir, AG-021541, ACH-806): doi:10.1002/hep.22549. HIV has many drug resistant mutations, see hivdb.stanford.edu/for more information. Aside from drug resistance, there are a number of clinically relevant mutations that could be targeted with the CRISPR systems according to the invention as described herein. For instance, persistent versus acute infection in LCMV: doi: 10.1073/pnas. 1019304108; or increased infectivity of Ebola: doi.org/10.1016/j.cell.2016.10.014 and doi.org/10.1016/j.cell.2016.10.013.

General Provisions

In an aspect, the invention provides a nucleic acid binding system, i.e. a CRISPR system or CRISPR/Cas system, more in particular a Class 2 type VI Crispr system. The nucleic acid binding system as described herein essentially comprises a CRISPR effector protein and a guide RNA.

In embodiments of the invention a guide RNA comprises a guide sequence and a direct repeat sequence. In general, a guide sequence (also called spacer sequence) is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-US' segment in LTR of HTLV-I (Mol. Cell. Biol., Vol. 8 (1), p. 466-472, 1988); SV40 enhancer; and the intron sequence between exons 2 and 3 of rabbit β-globin (Proc. Natl. Acad. Sci. USA., Vol. 78 (3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomaal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106 (1): 23-24; and P A Carr and G M Church, 2009, Nature Biotechnology 27(12): 1151-62).

These RNA structure prediction algorithms may also be used to predict the structure of the target RNA. As target RNA structure may have an influence of guide RNA binding efficiency or CRISPR system cleavage efficiency, prediction of the target RNA structure allows rational design of guide RNAs, such that for instance guide RNAs may be chosen to bind less structured areas of the target RNA, in order to improve for instance accessability. Accordingly, in certain embodiments, the one or more guide RNA as described herein bind less structured or unstructured areas of the target RNA. In certain embodiments, the guide RNA binds to accessible areas of the target RNA.

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such at at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

Also described is a challenge experiment to verify the RNA targeting and cleaving capability of a CRISPR effector. This experiment closely parallels similar work in E. coli for the heterologous expression of StCas9 (Sapranauskas, R. et al. Nucleic Acids Res 39, 9275-9282 (2011)). A plasmid containing both a PAM and a resistance gene are introduced into the heterologous E. coli, and then plate on the corresponding antibiotic. If there is RNA cleavage of the plasmid transcribed resistance gene, no viable colonies are observed.

In further detail, the assay is as follows for a DNA target, but may be adapted accordingly for an RNA target. Two E. coli strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12h after transformation, all colonies formed by the test and control strains where harvested and plasmid DNA was isolated. Plasmid DNA was used as template for PCR amplification and subsequent deep sequencing. Representation of all PAMs in the untransfomed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM. It will be understood that the above allows identification of PAM (or PFS) sequences (5' and/or 3') for any given CRISPR effector orthologue.

For minimization of toxicity and off-target effect, it will be important to control the concentration of nucleic acid-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The nucleic acid-targeting system is derived advantageously from a Type VI CRISPR system. In some embodiments, one or more elements of a nucleic acid-targeting system is derived from a particular organism comprising an endogenous RNA-targeting system. In particular embodiments, the Type VI RNA-targeting Cas enzyme is Cas 13a (C2c2) or Cas13b. In embodiments, the Type VI CRISPR effector protein such as C2c2 as referred to herein also encompasses a homologue or an orthologue of a Type VI protein. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. In particular embodiments, the homologue or orthologue of a Type VI protein such as C2c2 as referred to herein has a sequence homology or identity of at least 80%, more preferably at least 85%, even more preferably at least 90%, such as for instance at least 95% with a Type VI protein such as C2c2. In further embodiments, the homologue or orthologue of a Type VI protein such as C2c2 as referred to herein has a sequence identity of at least 80%, more preferably at least 85%, even more preferably at least 90%, such as for instance at least 95% with the wild type Type VI protein such as C2c2.

In an embodiment, the Type VI RNA-targeting Cas protein may be a C2c2 ortholog of an organism of a genus which includes but is not limited to Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma and Campylobacter. Species of organism of such a genus can be as otherwise herein discussed.

Some methods of identifying orthologs of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma and Campylobacter. A chimeric enzyme can comprise a first fragment and a second fragment, and the fragments can be of CRISPR enzyme orthologs of organisms of genuses herein mentioned or of species herein mentioned; advantageously the fragments are from CRISPR enzyme orthologs of different species.

In embodiments, the Type VI RNA-targeting effector protein, in particular the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be manmade. Advantageous embodiments can involve engineered or non-naturally occurring Type VI RNA-targeting effector protein.

In an embodiment, nucleic acid molecule(s) encoding the Type VI RNA-targeting effector protein, in particular C2c2 or an ortholog or homolog thereof, may be codon-optimized for expression in an eukaryotic cell. A eukaryote can be as herein discussed. Nucleic acid molecule(s) can be engineered or non-naturally occurring.

In an embodiment, the Type VI RNA-targeting effector protein, in particular C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the Type VI protein such as C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the Type VI protein such as C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the RNA-targeting effector protein may direct cleavage of one or both nucleic acid strands at the location of or near a target sequence, such as within the target sequence and/or within the complement of the target sequence or at sequences associated with the target sequence. In some embodiments, the nucleic acid-targeting Cas protein may direct cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a nucleic acid-targeting Cas protein that may be mutated with respect to a corresponding wild-type enzyme such that the mutated nucleic acid-targeting Cas protein lacks the ability to cleave RNA strands of a target polynucleotide containing a target sequence. As a further example, two or more catalytic domains of Cas (e.g. HEPN domain) may be mutated to produce a mutated Cas substantially lacking all RNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type VI CRISPR system. Most preferably, the effector protein is a Type VI protein such as C2c2. By derived, Applicants mean that the derived enzyme is largely based, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector proteinfrom the Type VI CRISPR locus. However, it will be appreciated that this invention includes many more effector proteinsfrom other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both DNA or RNA strands in or near (e.g., within 1, 2, 3, 4, 5, 6, 7, 8, 9, 10, 20, 50, 100, 200, 500, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, 100, 200, 500, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., C2c2) is within the ambit of the skilled artisan) . . . . Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

As used herein, the term "viral load" refers to viral burden, viral titre or viral titer, and is a numerical expression of the quantity of virus in a given volume, determined as viral particles, or infectious particles per ml.

CRISPR Effector Proteins

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, such as Cas13a, Cas13b, or Cas 13c in certain embodiments of the invention, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required. C2c2 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023., which is incorporated herein in its entirety by reference.

In certain embodiments, a protospacer adjacent motif (PAM) or PAM-like motif or protospacer flanking sequence (PFS) directs binding of the effector protein complex as disclosed herein to the target locus of interest. In some embodiments, the PAM may be a 5' PAM (i.e., located upstream of 5' end of the protospacer). In other embodiments, the PAM may be a 3' PAM (i.e., located downstream of 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein His A, C or U. In certain embodiments, the effector protein may be *Leptotrichia shahii* C2c2p, more preferably *Leptotrichia shahii* DSM 19757 C2c2, and 3' PAM is a 5' H.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

The nucleic acid molecule encoding a CRISPR effector protein, in particular C2c2 or Cas13b, is advantageously codon optimized CRISPR effector protein. An example of a codon optimized sequence, is in this instance a sequence optimized for expression in eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell, tissue, organ, or organism, in particular a C2c2 or Cas13b transgenic cell, tissue, organ, or organism, in which one or more guide RNAs or nucleic acids encoding one or more guide RNAs operably connected in the cell with a regulatory element comprising a promoter of one or more gene of interest are provided or introduced. As used herein, the term "Cas transgenic cell" refers to a cell, such as a eukaryotic cell, in which a Cas gene, such as a C2c2 ar CAS13b gene, has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159 (2): 440-455 (2014)), describing a Cas9 knock-in mouse, which is incorporated herein by reference. The Cas transgene can further comprise a Lox-Stop-polyA-Lox (LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In one example embodiment, the effector protein comprise one or more HEPN domains comprising a RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISRP Enzymes and Systems" and U.S. Provisional Patent Application entitled "Novel CRISPR Enzymes and Systems" filed on Mar. 15, 2017.

In an embodiment of the invention, a HEPN domain comprises at least one RxxxxH motif comprising the sequence of R{N/H/K}X1X2X3H. In an embodiment of the invention, a HEPN domain comprises a RxxxxH motif comprising the sequence of R{N/H}X1X2X3H. In an embodiment of the invention, a HEPN domain comprises the sequence of R{N/K}X1X2X3H. In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the CRISPR effector protein is naturally present in a prokaryotic genome within 20 kb upstream or downstream of a Cas gene or a CRISPR array. In certain example embodiments, the CRISPR effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related In particular embodiments, the Type VI RNA-targeting Cas enzyme is C2c2. In other example embodiments, the Type VI RNA-targeting Cas enzyme is Cas 13b. In particular embodiments, the homologue or orthologue of a Type VI protein such as C2c2 as referred to herein has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as C2c2 (e.g., based on the wild-type sequence of any of *Leptotrichia shahii* C2c2, Lachnospiraceae bacterium MA2020 C2c2, Lachnospiraceae bacterium NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae bacterium (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2). In further embodiments, the homologue or orthologue of a Type VI protein such as C2c2 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type C2c2 (e.g., based on the wild-type sequence of any of *Leptotrichia shahii* C2c2, Lachnospiraceae bacterium MA2020 C2c2, Lachnospiraceae bacterium NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae bacterium (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2).

In certain other example embodiments, the CRISPR system the effector protein is a C2c2 nuclease. The activity of C2c2 may depend on the presence of two HEPN domains. These have been shown to be RNase domains, i.e. nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR systems, reference is made to U.S. Provisional 62/351,662 filed on Jun. 17, 2016 and U.S. Provisional 62/376,377 filed on Aug. 17, 2016. Reference is also made to U.S. Provisional 62/351,803 filed on Jun. 17, 2016. Reference is also made to U.S. Provisional entitled "Novel Crispr Enzymes and Systems" filed Dec. 8, 2016 bearing Broad Institute No. 10035.PA4. Reference is further made to East-Seletsky et al. "Two distinct RNase activities of CRISPR-C2c2 enable guide-RNA processing and RNA detection" Nature doi:10/1038/nature19802 and Abudayyeh et al. "C2c2 is a single-component programmable RNA-guided RNA targeting CRISPR effector" bioRxiv doi:10.1101/054742.

RNase function in CRISPR systems is known, for example mRNA targeting has been reported for certain type III CRISPR-Cas systems (Hale et al., 2014, *Genes Dev*, vol. 28, 2432-2443; Hale et al., 2009, *Cell*, vol. 139, 945-956; Peng et al., 2015, *Nucleic acids research*, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a C2c2 ortholog of an organism of a genus which includes but is not limited to *Leptotrichia, Listeria,* Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologues of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria,* Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the CRISPR effector protein as referred to herein also encompasses a functional variant of the CRISPR effector or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein.

In an embodiment, nucleic acid molecule(s) encoding the CRISPR effector or an ortholog or homolog thereof, may be codon-optimized for expression in a eukaryotic cell. A eukaryote can be as herein discussed. Nucleic acid molecule(s) can be engineered or non-naturally occurring.

In an embodiment, the CRISPR effector or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the CRISPR effector or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the CRISPR effector or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In certain example embodiments, the CRISPR effector protein, in particular the C2c2 protein may be from an organism selected from the group consisting of: *Leptotrichia*, *Listeria*, *Corynebacter*, *Sutterella*, *Legionella*, *Treponema*, *Filifactor*, *Eubacterium*, *Streptococcus*, *Lactobacillus*, *Mycoplasma*, *Bacteroides*, *Flaviivola*, *Flavobacterium*, *Sphaerochaeta*, *Azospirillum*, *Gluconacetobacter*, *Neisseria*, *Roseburia*, *Parvibaculum*, *Staphylococcus*, *Nitratifractor*, *Mycoplasma*, and *Campylobacter*.

In certain embodiments, the effector protein may be a *Listeria* sp. C2c2p, preferably *Listeria seeligeria* C2c2p, more preferably *Listeria seeligeria* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a *Leptotrichia* sp., *Leptotrichia wadei* F0279, or a *Listeria* sp., preferably *Listeria newyorkensis* FSL M6-0635.

In certain example embodiments, the C2c2 effector proteins of the invention include, without limitation, the following 21 ortholog species (including multiple CRISPR loci: *Leptotrichia shahii*; *Leptotrichia wadei* (Lw2); *Listeria seeligeri*; Lachnospiraceae bacterium MA2020; Lachnospiraceae bacterium NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; Eubacteriaceae bacterium CHKCI004; *Blautia* sp. Marseille-P2398; and *Leptotrichia* sp. oral taxon 879 str. F0557. Twelve (12) further non-limiting examples are: Lachnospiraceae bacterium NK4A144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; Porphyromonadaceae bacterium KH3CP3RA; *Listeria riparia*; and *Insolitispirillum peregrinum*.

In certain embodiments, the C2c2 protein according to the invention is or is derived from one of the orthologues as described in Table 4 below, or is a chimeric protein of two or more of the orthologues as described in Table 4 below, or is a mutant or variant of one of the orthologues as described in Table 4 below (or a chimeric mutant or variant), including dead C2c2, split C2c2, destabilized C2c2, etc. as defined herein elsewhere, with or without fusion with a heterologous/functional domain.

In certain example embodiments, the C2c2 effector protein is selected from Table 4 below.

TABLE 4

| C2c2 orthologue | Code | Multi Letter |
|---|---|---|
| *Leptotrichia shahii* | C2-2 | Lsh |
| *L. wadei* F0279 (Lw2) | C2-3 | Lw2 |
| *Listeria seeligeri* | C2-4 | Lse |
| Lachnospiraceae bacterium MA2020 | C2-5 | LbM |
| Lachnospiraceae bacterium NK4A179 | C2-6 | LbNK179 |
| *Clostridium aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| Listeriaceae bacterium FSL M6-0635 | C2-12 | LbFSL |
| *Leptotrichia wadei* F0279 | C2-13 | Lw |
| Rhodobacter capsulatus SB 1003 | C2-14 | Re |
| *Rhodobacter capsulatus* R121 | C2-15 | Re |
| *Rhodobacter capsulatus* DE442 | C2-16 | Re |
| *Leptotrichia buccalis* C-1013-b | C2-17 | LbuC2c2 |
| *Herbinix hemicellulosilytics* | C2-18 | HheC2c2 |
| *Eubacterium rectale* | C2-19 | EreC2c2 |
| *Eubacteriaceae* bacterium CHKC1004 | C2-20 | EbaC2c2 |
| *Blautia* sp. Marseille-P2398 | C2-21 | BsmC2c2 |
| *Leptotrichia* sp. oral taxon 879 str. F0557 | C2-22 | LspC2c2 |
| Lachnospiraceae bacterium NK4a144 | | |
| *Chloroflexus aggregans* | | |
| *Demequina aurantiaca* | | |
| *Thalassospira* sp. TSL5-1 | | |
| *Pseudobutyrivibrio* sp. 0R37 | | |
| *Butyrivibrio* sp. YAB3001 | | |
| *Blautia* sp. Marseille-P2398 | | |
| *Leptotrichia* sp. Marseille-P300 | | |
| *Bacteroides ihuae* | | |
| Porphyromonadaceae bacterium KH3CP3RA | | |
| *Listeria riparia* | | |
| *Insolitispirillum peregrinum* | | |

The wild type protein sequences of the above species are listed in Table 5 below. In certain embodiments, a nucleic acid sequence encoding the C2c2 protein is provided.

TABLE 5

| C2c2-2 | *L. shahii* (Lsh) (SEQ. I.D. No. 1) | mgnlfghkrwyevrdkkdfkikrkvkvkrnydgnkyilninennnkekidnnkfirkyi nykkndnilkeftrkfhagnilfklkgkegiiriennddfleteevvlyieaygkseklkalgi tkkkiideairqgitkddkkieiknieneeeieidirdeytnktlndcsiilriiendeletkksi yeifkninmslykiiekiienetekvfenryyeehlrekllkddkidviltnfmeirekiksnl eilgfvkfylnvggdkkksknkkmlvekilninvdltvediadfvikelefwnitkriekv kkvnneflekrrnrtyiksyylldkhekfkierenkkdkivkffveniknnsikekiekilae fkidelikklekelkkgncdteifgifkkhykvnfdskkfskksdeekelykiiyrylkgrie |

TABLE 5-continued

| | | | |
|---|---|---|---|
| | | | kilvneqkvrlkkmekieiekilnesilsekilkrvkqytlehimylgklrhndidmttvnt ddfsrlhakeeldlelitffastnmelnkifsreninndenidffggdreknyvldkkilnski kiirdldfidnknnitnnfirkftkigtnernrilhaiskerdlqgtqddynkviniignikisd eevskalnldvvflcdkkniitkindikiseennndikylpsfskylpeilnlyrnnpknepf dtietekivlnaliyvnkelykkliledlleeneskniflgelkktlgnideideniienyykn aqisaskgnnkaikkyqkkviecyigylrknyeelfdfsdfkmniqeikkqikdindnkt yeritvktsdktivinddfeyiisifallnsnavinkirnrffatsvwlntseyqniidildeimq lntlrnecitenwnlnleefiqkmkeiekdfddfkiqtkkeifnnyyediknniltefkddin gcdvlekklekivifddetkfeidkksnilqdeqrklsninkkdlkkkvdqyikdkdqeik skilcriifnsdflkkykkeidnliedmesenenkfqeiyypkerknelyiykknlflnign pnfdkiyglisndikmadakflfnidgknirknkiseidailklnlndklngyskeykekyi kklkenddffakniqnknyksfekdynryseykkirdlvefnylnkiesylidinwklaiq marferdmhyivnglrelgiiklsgyntgisraypkrngsdgfytttayykffdeesykkfe kicygfgidlsenseinkpenesirnyishfyivrnpfadysiaeqidrvsnllsystrynnst yasvfevfkkdvnldydelkkkfklignnldilerlmkpkkvsvlelesynsdyiknliiellt kientndtlkrpaatkkagqakkkkgsypydvpdyaypydvpdyaypydvpdya |
| c2c2-3 | | L. wadei (Lw2) (SEQ. I.D. No. 2) | mkvtkvdgishkkyieegklykstseenrtserlsellsirldiyiknpdnaseeeenrirrenl kkffsnkvlhlkdsvlylknrkeknavqdknyseediseydlknknsfsvlkkillnedvn seeleifrkdveaklnkinslkysfeenkanyqkinennvekvggkskrniiydyyresak rndyinnvqeafdklykkediekifflienskhekykireyyhkiigrkndkenfakiiye eiqnvnnikeliekipdmselkksqvfykyyldkeelndknikyafchfveiemsqllkn yvvkrlsnisndkikrifeyqnlkklienkllnkldtyvrncgkynyylqvgeiatsdfiarn rqneaflrniigvssvayfslrniletenenditgrmrgktvknnkgeekyvsgevdkiyne nkqnevkenlkmfysydfnmdnkneiedffanideaissirhgivhfnlelegkdifafk niapseiskkmfqneinekklklkifkqlnsanvfnyyekdviikylkntkfnfvnknipf vpsftklynkiedlrntlkffwsvpkdkeekdaqiyllkniyygeflnkfvknskvfflcitn evikinkqrnqktghykyqkfeniektvpveylaiiqsreminnqdkeekntyidfiqqif lkgfidylnknnlkyiesnnnndnndifskikikkdnkekydkilknyekhnrnkeiphe inefvreiklgkilkytenlnmfylilkllnhkeltnlkgslekyqsankeetfsdelelinllnl dnnrytedfeleaneigkfldfnenkikdrkelkkfdtnkiyfdgeniikhrafynikkyg mlnllekiadkakykislkelkeysnkkneieknytmqqnlhrkyarpkkdekfndedy keyekaigniqkythlknkvefnelnllqglllkilhrlvgytsiwerdlrfrlkgefpenhyi eeifnfdnsknvkyksgqivekyinfykelykdnvekrsiysdkkvkklkqekkdlyirn yiahfnyiphaeisllevlenlrkllsydrklknaimksivdilkeygfvatflcigadkkieiq tlesekivhlknlkkkklmtdrnseelcelvkvmfeykalekrpaatkkagqakkkkgsy pydvpdyaypydvpdyaypydvpdya* |
| c2c2-4 | | Listeria seeligeri (SEQ. I.D. No. 3) | mwisiktlihhlgvlffedymynrreldciievktmritkvevdrkkvlisrdknggklvye nemqdnteqimhhkkssfyksvvnkticrpeqkqmkklvhgllqensqekikvsdvtk lnisnflnhrfkkslyyfpenspdkseeyrieinlsqlledslkkqqgtficwesfskdmely inwaenyissktklikksirnnriqstesrsgqlmdrymkdilnknkpfdiqsvsekyqle kltsalkatfkeakkndkeinyklkstlqnherqiieelkenselnqfnieirkhletyfpikkt nrkvgdirnleigeiqkivnhrlknkivqrilqegklasyeiestvnsnslqkikieeafalkfi naclfasnnlrnmvypvckkdilmigefknsfkeikhhkkfirqwsqffsqeitvddielas wglrgaiapirneiihlkkhswkkffnnptfkvkkskiingktkdvtseflyketlflcdyfy seldsvpeliinkmesskildyyssdqlnqvftipnfelslltsavpfapsflcrvylkgfdyq nqdeaqpdynlklniynekafnseafqaqyslfkmvyyqvflpqftttnndlfkssvdfiltl nkerkgyakafqdirkmnkdekpseymsyiqsqlmlyqkkqeekekinhfekfinqvf ikgfnsfieknatyichptkntvpendnieipfhtdmddsniafwlmcklldakqlselrn emikfscslqsteeistfttkareviglallngekgcndwkelfddkeawkknmslyvseel lqslpytqedgqtpvinrsidlykkygtetilekelfsssddykvsakdiaklheydvtekiaq qeslhkqwiekpglardsawtkkyqnvindisnyqwaktkveltqvrhlhqltidllsrla gymsiadrdfqfssnyilerenseyrvtswillsenknknkyndyelynlknasikvsskn dpqlkvdlkqlrltleylelfdnrlkekrnnishfnylngqlgnsilelfddardvlsydrklk naysksIskeilsshgmevtflcplyqtnhhlkidklqpkkihhlgekstvssnqvsneycql vrtlltmk |
| c2c2-5 | 1 | Lachno- spiraceae bacterium MA2020 (SEQ. I.D. No. 4) | mqisvknhkhvavgqkdrereritgfiynpvgdeksledvvakrandtkvlfnvfntkdly dsqesdksekdkeiiskgakfvaksfnsaitilkkqnkiystltsqqvikelkdkfggariyd ddieealtetlkkssfrkenvrnsikvlienaagirsslskdeeliqeyfvkqlveeytktklq knvyksiknqnmviqpdsdsqvlslsesrrekqssayssdtlynckekdvlkafltdyavl dedernsllwklrnlvnlyfygsesirdysytkeksvwkehdeqkanktlfideichitkg kngkeqkvldyeenrsrcrkqninyyrsalnyaknntsgifenedsnhfwihlieneverl yngiengeefkfetgyisekvwkavinhlsikyialgkavynyamkelsspgdiepgkid dsyingitsfdyeiikaeeslqrdismnvvfatnylacatvdtdkdflllfskedirsctkkdgn lcknimqfwggystwknfceeylkddkdalellyslksmlysmrnssfhfstenvdngs wdteligklfeedcnraariekekfynnnlhmfysssllekvlerlysshherasqvpsfnr vfvrknfpsslseqritpkftdskdeqiwqsavyylckeiyyndflqseaykIfregvknl dkndinnqkaadsflcqavvyygkaignatlsqvcqaimteynrqnndglkkksayaek qnsnkykhyplflkqvlqsafweyldenkeiygfisaqihksnveikaedfianyssgqy kklvdkvkktpelqkwytIgrlinprqanqflgsirnyvqfvkdiqrrakengnpirnyye vlesdsiikilemakingttsndihdyfrdedeyaeyisqfvnfgdvhsgaalnafcnses egkkngiyydginpivnrnwvlcklygspdliskiisrvnenmihdfhkqedlireyqik gicsnkkeqqdlrtfqvlknrvelrdiveyseiinelygglikwcylrerdlmyfqlgfhylc lnnassskeadyikinvddrnisgailyqiaamyinglpvyykkddmyvalksgkkasde lnsneqtskkinyflkygnnilgdkkdqlylaglelfenvaeheniiifrneidhfhyfydrd rsmldlysevfdrfftydmklrknvvnmlyinilldhnivssfvfetgekkvgrgdsevikp sakirllrranngvssdvftykvgskdelkiatlpakneefllnvarliyypdmeavsenmvr egvvkveksndkkgkisrgsntrssnqskynnkskrmnysmgsifekmdlkfd |

TABLE 5-continued

| c2c2-6 | 2 | Lachno-spiraceae bacterium NK4A179 (SEQ. I.D. No. 5) | mkiskvreenrgaklvnaktavvsenrsqegilyndpsrygksrkndedrdryieslks sgklyrifnedknkretdelqwflseivkkinrrnglvlsdmlsvddrafekafekyaelsyt nrrnkvsgspafetcgvdaataerlkgiisetnfinriknnidnkvsediidriiakylkkslcr ervkrglkkllmnafdlpysdpdidvqrdfidyvledfyhvraksqvsrsiknmnmpvq pegdgkfaitvskggtesgnkrsaekeafkkflsdyaslderrddmlrrmrrlvvlyfyg sddsklsdvnekfdvwedhaarrvdnrefikplpenklangktdkdaerirkntykelyrn qnigcyrqavkaveednngryfddkmlnmffihrieygvekiyanlkqvteflcartgyls ekiwkdlinyisikyiamgkavynyamdelnasdkkeielgkiseeylsgissfdyelika eemlqretavyvafaarhlssqtveldsensdfllllpkgtmdkndknklasnnilnflkdk etlrdtilqyfgghslwtdfpfdkylaggkddvdfltdlkdviysmrndsfhyatenhnng kwnkelisamfeheetermtvvmkdkfysnnlpmfyknddlkklidlykdnverasqv psfnkvfvrknfpalvrdkdnlgieldlkadadkgenelkfynalyymflceiyynaflnd knvrerfitkatkvadnydrnkernlkdriksagsdekkklreqlqnyiaendfgqrikniv qvnpdytlaqicqlimteynqqnngcmqkksaarkdinkdsyqhykmllvnlrkafle fikenyafvlkpykhdlcdkadfvpdfakyvkpyaglisrvagsselqkwyivsrflspaq anhmlgflhsykqyvwdiyrrasetgteinhsiaedkiagvditdvdavidlsvklcgtiss eisdyflcddevyaeyissyldfeydggnykdslnrfcnsdavndqkvalyydgehpkln rniilsklygerrflekitdrvsrsdiveyyylkkketsqyqtkgifdsedeqknikkfqemkn ivefrdlmdyseiadelqgqlinwiylrerdlmnfqlgyhyaclnndsnkqatyvtldyqg kknrkingailyqicamyinglplyyvdksssewtvsdgkestgakigefyryaksfents dcyasgleifenisehdnitelrnyiehfryyssfdrsflgiysevfdrfftydlkyrknvptil ynillqhfvnvrfefvsgkkmigidkkdrkiakekecaritireknqvyseqftyklkngtv yvdardkryllqsiirllfypekvnmdemievkekkkpsdnntgkgyskrdrqqdrkeyd kykekkkkegnflsgmgginwdeinaqlkn |
| c2c2-7 | 3 | Clostridium aminophilum DSM 10710 (SEQ. I.D. No. 6) | mkfskvdhtrsavgiqkatdsvhgmlytdpkkqevndldkrfdqlnvakrlynvfnqs kaeeddekrfgkvvkklnrelkdllfhrevsrynsignakynyygiksnpeeivsnlgm veslkgerdpqkviskllllyylrkglkpgtdglrmileascglrklsgdekelkvflqtldedf ekktfkknlrisienqnmavqpsnegdpiigitqgrfnsqkneeksaiermmsmyadln edhredvlrklrrinvlyfnvdtekteeptlpgevdtnpvfevwhdhekgkendrqfatfa kiltedretrkkeklavkealndlksairdhnimayrcsikvteqdkdglffedqrinrfwih hiesaverilasinpeklyklrigylgekvwkdllnylsikyiavgkavfhfamedlgktgq dielgklsnsysggltsfdyeqiradetlqrqlsvevafaannlfravvgqtgkkiegkksee needfllwkaekiaesikkegegntlksilqffggasswdlnhfcaaygnessalgyetkfa ddlrkaiyslrnetfhfttlnkgsfdwnakligdmfsheaatgiavertrfysnnlpmfyres dlkrimdhlyntyhprasqvpsfnsvfvrknfrlflsntlntntsfdtevyqkwesgvyylf keiyynsflpsgdahhlffeglrrirkeadnlpivgkeakkrnavqdfgrrcdelknlslsai cqmimteyneqnngnrkykstredkrkpdifqhykmlllrtlqeafaiyirreeflcfifdlp ktlyvmkpveeflpnwksgmfdslvervkqspdlqrwyvlckflngrllnqlsgvirsyi qfagdiqrrakanhnrlymdntqrveyysnvlevvdfcikgtsrfsnvfsdyfrdedayad yldnylqflcdekiaevssfaalktfcneeevkagiymdgenpvmqrnivmaklfgpde vlknvvpkvtreeieeyyqlekqiapyrqngyckseedqkkllrfqriknrvefqtitefsei inellgqliswsflrerdllyfqlgfhylclhndtekpaeykeisredgtvirnailhqvaamy vgglpvytladkklaafekgeadcklsiskdtagagkkikdffryskyvlikdrmltdqnq kytiylaglelfentdehdnitdvrkyvdhfkyyatsdenamsillsyeihdrfftydmky qknvanmlenillrhfvlirpefftgskkvgegkkitckaraqieiaengmrsedftyklsd gkknistcmiaardqkylntvarllyypheakksivdtrekknnkktnrgdgtfnkqgta rkekdngprefndtgfsntpfagfdpfrns |
| c2c2-8 | 5 | Carno-bacterium gallinarum DSM 4847 (SEQ. I.D. No. 7) | mritkvkikldnklyqvtmqkeekygtlklneesrkstaeilrlkkasfnksfhsktinsqk enknatikkngdyisqifeklvgvdtnknirkpkmsltdlkdlpkkdlalfikrkfknddiv eiknldlislfynalqkvpgehftdeswadfcqemmpyreyknkfierkiillansieqnk gfsinpetfskrkrvlhqwaievqergdfsildeklsklaeiynfkkmckrvgdelndleks mkkgknpekekeaykkqknflciktiwkdypykthigliekikeneelnqfnieigkyfe hyfpikkerctedepyylnsetiattvnyqlknalisylmqigkykqfglenqvldskklqe igiyegfqtkfmdacvfatsslknieipmrsgdilgkrefkeaiatssfvnyhhffpyfpfel kgmkdreselipfgeqteakqmqniwalrgsvqqirneifhsfdknqkfnlpqldksnfe fdasenstgksqsyietdykflfeaeknqleqffierikssgaleyyplkslekIfakkemkf slgsqvvafapsykklvkkghsyqtategtanylglsyynryelkeesfqaqyyllkliyqy vflpnfsqgnspafretvkailrinkdearkmkknkkflrkyafeqvremefketpdqy msylqsemreekvrkaekndkgfeknitmnfekllmqifvkgfdvflttfagkellssee kviketeislskkinerektlkasiqvnqlvatnsaisywlfckIldsrhlnelrnemikflcq srikfnhtqhaeliqnllpiveltilsndydekndsqnvdvsayfedkslyetapyvqtddrt rvsfrpilklekyhtksllealkdnpqfrvaatdiqewmhkreeigelvekrknlhtewae gqqqtlgaekreeyrdyckkidrfnwkankvtltylsqlhylitdllgrmvgfsalferdlvyf srsfselggetyhisdyknlsgvlrinaevkpikiknikvidneenpykgnepevkpfldrl haylenvigikavhgkirnqtahlsvlqlelsmiesmnnlrdlmaydrklknavtksmiki ldkhgmilklkidenhknfeieslipkeiihlkdkaiktnqvseeycqlvlallttnpgnqln |
| c2c2-9 | 6 | Carno-bacterium gallinarum DSM 4847 (SEQ. I.D. No. 8) | mrmtkvkingspvsmnrsklnghlywngttntvniltkkeqsfaasflnktivkadqvkg ykvlaenifiifeqleksnsekpsvylnnirrlkeaglkrfflcskyheeikytseknqsvptkl nlipffnavdriqedkfdeknwsyfckemspyldykksylnrkkeilansiqqnrgfsm ptaeepnllskrkqlfqqwamkfqesplliqqnnfaveqfnkefankinelaavynvdelc taiteklmnfdkdksnktrnfeikklwkqhpmhkdkaliklfhnqegnealnqfnielgkyf ehyfpktgkkesaesyylnpqtiiktvgyqlrnafvqyllqvgklhqynkgvldsqtlqeig myegfqtkfmdacvfassslrniiqattnediltrekflckeleknvelkhdlffkteiveerd enpakkiamtpneldlwairgavqrvrnqifhqqinkrhepnqlkvgsfengdlgnvsy qktiyqklfdaeikdieiyfaekiksssgaleqysmkdleklfsnkeltlsggqvvafapsyk klykqgyfyqnektieleqftdydfsndvfkanyylikliyhyvflpqfsgannklfkdtvh |

TABLE 5-continued

| | | | |
|---|---|---|---|
| | | | yviqqnkelnttekdkknnkkirkyafeqvklmknespekymqylqremqeertikea
kktneekpnynfekliqifikgfdtflrnfdlnlnpaeelvgtvkekaeglrkrkeriakiln
vdeqiktgdeeiafwifaklldarhlselrnemikflcqssvkkglikngdlieqmqpilelci
lsndsesmekesfdkievflekvelaknepymqedkltpvkfrfmkqlekyqtrnfienl
vienpefkvsekivinwheekekiadlvdkrtklheewaskareieeynekikknkskkl
dkpaefakfaeykiiceaienfnrldhkvrltylknlhylmidlmgrmvgfsvlferdfvy
mgrsysalkkqsiylndydtfanirdwevnenkhlfgtsssdltfqetaefknlkkpmenq
lkallgvtnhsfeirnniahlhvlrndgkgegvsllscmndlrklmsydrklknavtkaiiki
ldkhgmilkltnndhtkpfeieslkpkkiihleksnhsfpmdqvsqeyсdlvkkmlvftn |
| c2c2-10 | 7 | Paludibacter propionicigenes WB4 (SEQ. I.D. No. 9) | mrvskykykdggkdkmvlvhrkttgaqlvysgqpvsnetsnilpekkrqsfdlstlnkti
kfdtakkqklnvdqykivekificypkqelpkqikaeeilpflnhkfqepvkykwngkee
sfnitlliveavqaqdkrklqpyydwkttwyiqtksdllkksiennridltenlskrkkallaw
eteftasgsidlthyhkvymtdvlckmlqdvkpltddkgkintnayhrglkkalqnhqpa
ifgtrevpneanradnqlsiyhlevvkylehyfpiktskrrntaddiahylkaqtlkttiekql
vnairaniiqqgktnhhelkadttsndliriktneafvinitgtcafaannirnmvdneqtndi
lgkgdfikslkdntnsqlysffgeglstnkaeketqlwgirgavqqirnnvnhykkdalk
tvfnisnfenptitdpkqqtnyadtiykarfinelekipeafaqqlktggaysyytienlksllt
tfqfslcrstipfapgfkkvfngginyqnakqdesfyelmleqylrkenfaeesynaryfml
kliynnlflpgfttdrkafadsvgfvqmqnkkqaekvnprkkeayafeavrpmtaadsia
dymayvqselmqeqnkkeekvaeetrinfekfvlqvfikgfdsflrakefdfvqmpqpq
ltatasnqqkadklnqleasitadcklltpqyakaddathiafyvfcklldaahlsnlrnelikfr
esvnefkfhhlleiieicllsadvvptdyrdlysseadclarlrpfieqqaditnwsdlfvqsd
khspvihanielsvkygttklleqiinkdtqfktteanftawntaqksieqlikqredhheq
wvkaknaddkekqerkreksnfaqkfiekhgddyldicdyintynwldnkmhfvhlnr
lhgltiellgrmagfvalfdrdfqffdeqqiadefklhgfvnlhsidkklnevptkkikeiydi
rnkiiqingnkinesvranliqfisskrnyynnaflhvsndeikekqmydirnhiahfnylt
kdaadfslidlinelrellhydrklknayskafidlfdkhgmilklklnadhklkveslepkk
iyhlgssakdkpeyqyctnqvmmaycnmcrsllemkk |
| c2c2-11 | 9 | Listeria weihen-stephanensis FSL R9-0317 (SEQ. I.D. No. 10) | mlallhqevpsqklhnlkslnteslltklfkpkfqnmisyppskgaehvqfcltdiavpaird
ldeikpdwgiffeklkpytdwaesyihykqttiqksieqnkiqspdsprklvlqkyvtafln
gepglgldlvakkykladlaesfkvvdlnedksanykikaclqqhqrnildelkedpelnqy
gievkkyiqryfpikrapnrskharadflkkeliestveqqfknavyhyvleqgkmeayel
tdpktkdlqdirsgeafsfkfinacafasnnlkmilnpecekdilgkgdfkknlpnsttqsd
vvkkmipffsdeiqnvnfdeaiwairgsiqqirnevyhckkhswksilkikgfefepnn
mkytdsdmqklmdkdiakipdfieeklkssgiirfyshdklqsiwemkqgfsllttnapf
vpsfkrvyakghdyqtsknryydlgltffdileygeedfraryfltklvyyqqfmpwftad
nnafrdaanfvlrinknrqqdakafinireveegemprdymgyvqgqiaihedstedtpn
hfekfisqvfikgfdshmrsadlkfiknprnqgleqseieemsfdikvepsflknkddyia
fwtfckmldarhlselrnemikydghltgeqeiiglallgvdsrendwkqffssereyeki
mkgyvgeelyqrepyrqsdgktpilfrgvegarkygtetviqrlfdaspefkvskcnitew
erqketieetierrkelhneweknpkkpqnnaffkeykecсdaidaynwhknkttivyv
nelhhllieilgryvgyvaiadrdfqcmanqyfkhsgiterveywgdnrlksikkldtflkk
eglfvseknarnhiahlnylslksectllylserlreifkydrklknaysksliidildrhgmsv
vfanlkenkhrlvikslepkklrhlgekkidngyietnqvseeycgivkrllei |
| c2c2-12 | 10 | Listeriaceae bacterium FSL M6-0635 = Listeria newyorkensis FSL M6-0635 (SEQ. I.D. No. 11) | mkitkmrvdgrtivmertskeggqlgyegidgnkttefiifdkkkesfyksilnktvrkpdek
eknrrkqainkainkeitelmlavlhqevpsqklhnlkslnteslltklfkpkfqnmisypps
kgaehvqfcltdiavpairdldeikpdwgiffeklkpytdwaesyihykqttiqksieqnki
qspdsprklvlqkyvtaflngeplgldlvakkykladlaesfklvdlnedksanykikaclq
qhqrnildelkedpelnqygievkkyiqryfpikrapnrskharadflkkeliestveqqfk
navyhyvleqgkmeayeltdpktkdlqdirsgeafsfkfinacafasnnlkmilnpecek
dilgkgnfkknlpnsttrsdvvkkmipffsdelqnvnfdeaiwairgsiqqirnevyhckk
hswksilkikgfefepnnmkyadsdmqklmdkdiakipefieeklkssgvvrfyrhdel
qsiwemkqgfsllttnapfvpsfkrvyakghdyqtsknryynldltttfdileygeedfrary
fltklvyyqqfmpwftadnnafrdaanfvlrinknrqqdakafinireveegemprdym
gyvqgqiaihedsiedtpnhfekfisqvfikgfdrhmrsanlkfiknprnqgleqseieem
sfdikvepsflnkddyiafwifckmldarhlselrnemikydghltgeqeliglallgvds
rendwkqffssereyekimkgyvveelyqrepyrqsdgktpilfrgveqarkygtetviqr
lfdanpefkvskcnlaewerqketieetikrrkelhnewaknpkkpqnnaffkeykecсd
aidaynwhknkttlayvnelhhllieilgryvgyvaiadrdfqcmanqyfkhsgitervey
wgdnrlksikkldtflkkeglfvseknarnhiahlnylslksectllylserlreifkydrklkn
ayskslidildrhgmsvvfanlkenkhrlvikslepkklrhlggkkidggyietnqvseeyc
givkrllem |
| c2c2-13 | 12 | Leptotrichia wadei F0279 (SEQ. I.D. No. 12) | mkvtkvdgishkkyieegklyksteenrtserlsellsirldiyiknpdnaseeenrirrenl
kkffsnkvlhlkdsvlyknrkeknavqdknyseediseydlknknsfsvlkkillnedvn
seeleifrkdveaklnkinslkysfeenkanyqkinennvekvggksrkniiydyyresak
rndyinnvqeafdklykkediekflfflienskkhekykireyyhkiigrkndkenfakiiye
eiqnvnnikeliekipdmselkksqvfkykyyldkeelndknikyafchfveiemsqllkn
yvykrlsnisndkikrifeyqnlkklienkllnkldtyvrncgkynyylqvgeiatsdfiarn
rqneaflrniigvssvayfslrniletenenditgrmrgktvknnkgeekyvsgevdkiyne
nkqnevkenlkmfysydfnmdknkneiedffanideaissirhgivhfnlelegkdifafk
niapseiskkmfqneinekkklkikfkqlnsanvfnyyekdviikylkntkfnfvknipf
vpsftklynkiedlrntlkffwsvpkdkeekdaqiyllkniyygeflnkfvknskvfflcitn
evikinkqrnqktghykyqkfeniekttvpveylaiiqsreminnqdkeekntyidfiqqif
lkgfidylnknnlkyiesnnnndnnifskikikkdnkekydilknyekhnrnkeiphe
inefvreiklgkilkytenlnmfylilkllnhkeltnlkgslekyqsankeetfsdelelinllnl
dnnrytedfeleaneigkfldfnenkikdrkelkkfdtnkiyfdgeniikhrafyniikkyg |

TABLE 5-continued

| | | | |
|---|---|---|---|
| | | | mlnllekiadkakykislkelkeysnkkneieknytmqqnlhrkyarpkkdekfndedy keyekaigniqkythlknkvefnelnllqglllkilhrlvgytsiwerdlrfrlkgefpenhyi eeifnfdnsknvkyksgqivekyinfykelykdnvekrsiysdkkvklkqekkdlyirn yiahfnyiphaeisllevlenlrkllsydrklknaimksivdilkeygfvatflcigadkkieiq tlesekivhlknlkkkklmtdrnseelcelvkvmfeykale |
| c2c2-14 | 15 | *Rhodobacter capsulatus* SB 1003 (SEQ. I.D. No. 13) | mqigkvqgrtisefgdpagglkrkistdgknrkelpahlssdpkaligqwisgidkiyrkp dsrksdgkaihsptpskmqfdarddlgeafwklvseaglaqdsdydqfkrrlhpygdkf qpadsgaklkfeadppepqafhgrwygamskrgndakelaaalyehlhvdekridgqp krnpktdkfapglvvaralgiessylprgmarlarnwgeeeiqtyfvvdvaasykevaka aysaaqafdpprqvsgrslspkvgfalaehlervtgskrcsfdpaagpsvlalhdevkkty krlcargknaarafpadkteallalmrhthenrvrnqmvrmgryseyrgqqagdlaqshy wtsagqteikeseifvrlwvgafalagrsmkawidpmgkivnteknrdrdltaavnirqvi snkemvaeamarrgiyfgetpeldrlgaegnegfvfallrylrgcrnqtfhlgaragflkeir kelektrwgkakeaehvyltdktvaairaiidndakalgarllladlsgafvahyaskehfstl yseivkavkdapevssglprlklllkradgvrgyvhglrdtrkhafatklppppaprelddp atkaryiallrlydgpfrayasgitgtalagpaarakeaatalagpsvnvtkaysdvmegrtsrl rppndgetlreylsaltgetatefrvqigyesdsenarkqaefienyrrdmlafmfedyirak gfdwilkiepgatamtrapvlpepidtrgqyehwqaalylvmhfvpasdvsnllhqlrk wealqgkyelvqdgdatdqadarrealdlykrfrdvlvlflktgearfegraapfdlkpfral fanpatfdrlfmatpttarpaeddpegdgasepelrvartlrglrqiarynhmavlsdlfakh kvrdeevarlaeiedetqeksqivaagelrtdlhdkvmkchpktispeerqsyaaaiktiee hrflvgrvylgdhlrlhrlmmdvigrlidyagayerdtgtflinaskqlgagadwavtiaga antdartqtrkdlahfnvldradgtpdltalvnraremmaydrkrknavprsildmlarlglt lkwqmkdhllqdatitqaaikhldkvrltvggpaavtearfsqdylqmvaavfngsvqnp kprrrddgdawhkppkpataqsqpdqkppnkapsagsrlpppqvgevyegvvvkvid tgslgflavegvagniglhisrlrriredaiivgrryrfrveiyvppksntsklnaadlvrid |
| c2c2-15 | 16 | *Rhodobacter capsulatus* R121 (SEQ. I.D. No. 14) | mqigkvqgrtisefgdpagglkrkistdgknrkelpahlssdpkaligqwisgidkiyrkp dsrksdgkaihsptpskmqfdarddlgeafwklvseaglaqdsdydqfkrrlhpygdkf qpadsgaklkfeadppepqafhgrwygamskrgndakelaaalyehlhvdekridgqp krnpktdkfapglvvaralgiessylprgmarlarnwgeeeiqtyfvvdvaasykevaka aysaaqafdpprqvsgrslspkvgfalaehlervtgskrcsfdpaagpsvlalhdevkkty krlcargknaarafpadkteallalmrhthenrvrnqmvrmgrvseyrgqqagdlaqshy wtsagqteikeseifvrlwvgafalagrsmkawidpmgkivnteknrdrdltaavnirqvi snkemvaeamarrgiyfgetpeldrlgaegnegfvfallrylrgcrnqtfhlgaragflkeir kelektrwgkakeaehvyltdktvaairaiidndakalgarllladlsgafvahyaskehfstl yseivkavkdapevssglprlklllkradgvrgyvhglrdtrkhafatklppppaprelddp atkaryiallrlydgpfrayasgitgtalagpaarakeaatalaqsvnvtkaysdvmegrssrl rppndgetlreylsaltgetatefrvqigyesdsenarkqaefienyrrdmlafmfedyirak gfdwilkiepgatamtrapvlpepidtrgqyehwqaalylvmhfvpasdvsnllhqlrk wealqgkyelvqdgdatdqadarrealdlykrfrdvlvlflktgearfegraapfdlkpfral fanpatfdrlfmatpttarpaeddpegdgasepelrvartlrglrqiarynhmavlsdlfakh kvrdeevarlaeiedetqeksqivaagelrtdlhdkvmkchpktispeerqsyaaaiktiee hrflvgrvylgdhlrlhrlmmdvigrlidyagayerdtgtflinaskqlgagadwavtiaga antdartqtrkdlahfnvldradgtpdltalvnraremmaydrkrknavprsildmlarlglt lkwqmkdhllqdatitqaaikhldkvrltvggpaavtearfsqdylqmvaavfngsvqnp kprrrddgdawhkppkpataqsqpdqkppnkapsagsrlpppqvgevyegvvvkvid tgslgflavegvagniglhisrlrriredaiivgrryrfrveiyvppksntsklnaadlvrid |
| c2c2-16 | 17 | *Rhodobacter capsulatus* DE442 (SEQ. ID. No. 15) | mqigkvqgrtisefgdpagglkrkistdgknrkelpahlssdpkaligqwisgidkiyrkp dsrksdgkaihsptpskmqfdarddlgeafwklvseaglaqdsdydqfkrrlhpygdkf qpadsgaklkfeadppepqafhgrwygamskrgndakelaaalyehlhvdekridgqp krnpktdkfapglvvaralgiessvlprgmarlarnwgeeeiqtyfvvdvaasvkevaka aysaaqafdpprqvsgrslspkvgfalaehlervtgskrcsfdpaagpsvlalhdevkkty krlcargknaarafpadkteallalmrhthenrvrnqmvrmgrvseyrgqqagdlaqshy wtsagqteikeseifvrlwvgafalagrsmkawidpmgkivnteknrdrdltaavnirqvi snkemvaeamarrgiyfgetpeldrlgaegnegfvfallrylrgcrnqtfhlgaragflkeir kelektrwgkakeaehvyltdktvaairaiidndakalgarllladlsgafvahyaskehfstl yseivkavkdapevssglprlklllkradgvrgyvhglrdtrkhafatklppppaprelddp atkaryiallrlydgpfrayasgitgtalagpaarakeaatalaqsvnvtkaysdvmegrssrl rppndgetlreylsaltgetatefrvqigyesdsenarkqaefienyrrdmlafmfedyirak gfdwilkiepgatamtrapvlpepidtrgqyehwqaalylvmhfvpasdvsnllhqlrk wealqgkyelvqdgdatdqadarrealdlykrfrdvlvlflktgearfegraapfdlkpfral fanpatfdrlfmatpttarpaeddpegdgasepelrvartlrglrqiarynhmavlsdlfakh kvrdeevarlaeiedetqeksqivaagelrtdlhdkvmkchpktispeerqsyaaaiktiee hrflvgrvylgdhlrlhrlmmdvigrlidyagayerdtgtflinaskqlgagadwavtiaga antdartqtrkdlahfnvldradgtpdltalvnraremmaydrkrknavprsildmlarlglt lkwqmkdhllqdatitqaaikhldkvrltvggpaavtearfsqdylqmvaavfngsvqnp kprrrddgdawhkppkpataqsqpdqkppnkapsagsrlpppqvgevyegvvvkvid tgslgflavegvagniglhisrlrriredaiivgrryrfrveiyvppksntsklnaadlvrid |
| LbuC2c2 | | *Leptorichia buccalis* C-1013-b (SEQ ID NO: 16) | mkvtkvggishkkytsegrlvkseseenrtderlsallnmrldmyiknpsstetkenqkri gklkkffsnkmvylkdntlslkngkkenidreysetdilesdvrdkknfavlkkiylnenv nseelevfrndikkklknkinslkysfeknkanyqkinenniekvegkskrniiydyyresa krdayvsnvkeafdklykeediaklvleieinitkklekykirefyheiigrkndkenfakiiye eiqnvnnmkelievpdmselkksqvfykyyldkeelndnikyafchfveiemsqllk nyvyvkrlsnisndkikrifeyqnlkklienkllnkldtyvrncgkynyylqdgeiatsdfiar nrqneaflrniigvssvayfslrnileteneneditgrmrgktvknnkgeekyvsgevdkiyn enkknevkenlkmfysydfnmdnkneiedffanideaissirhgivhfnlelegkdifaf |

TABLE 5-continued

| | | |
|---|---|---|
| | | kniapseiskkmfqneinekklklkifrqlnsanvfrylekykilnylkrtrfefvnknipfv<br>psftklysriddlknslgiywktpktnddnktkeiidaqiyllkniyygeflnyfmsnngnf<br>feiskeiielnkndkrnlktgfyklqkfediqekipkeylaniqslyminagnqdeeekdty<br>idfiqkiflkgfmtylanngrlsliyigsdeetntslaekkqefdkflkkyeqnnnikipyein<br>eflreiklgnilkyterinmfylilklhnhkeltnlkgslekyqsankeeafsdqlelinllndn<br>nrytedfeleadeigkfldfngnkvkdnkelkkfdtnkiyfdgeniikhrafynikkygml<br>nllekiadkagykisieelkkysnkkneieknhkmqenlhrkyarprkdekftdedyesy<br>kqaienieeythlknkvefnelnllqglllrilhrlvgytsiwerdlrfrlkgefpenqyieeif<br>nfenkknvkykggqivekyikfykelhqndevkinkyssanikvlkqekkdlyirnyia<br>hfnyiphaeisllevlenlrkllsydrklknavmksvvdilkeygfvatflcigadkkigiqtl<br>esekivhlknlkkkklmtdrnseelcklvkimfeykmeekksen |
| HheC2c2 | *Herbinix hemicellulos ilytica* (SEQ ID NO: 17) | mkltrrrisgnsvdqkitaafyrdmsqgllyydsedndctdkviesmdferswrgrilkng<br>eddknpfymfvkglvgsndkivcepidvdsdpdnldilinknitgfgrnlkapdsndtle<br>nlirkiqagipeeevlpelkkikemiqkdivnrkeqllksiknnripfslegsklvpstkkm<br>kwlfklidvpnktfnekmlekyweiydydklkanitnrldktdkkarsisravseelreyh<br>knlrtnynrfvsgdrpaagldnggsakynpdkeefllflkeveqyfkkyfpvkskhsnks<br>kdkslvdkyknycsykvvkkevnrsiinqlvagliqqgkllyyfyyndtwqedflnsygl<br>syiqveeafkksvmtslswginrltsffiddsntvkfddittkkakeaiesnyfnklrtcsrm<br>qdhfkeklaffypvyvkdkkdrpdddienlivlvknaiesvsylrnrtfhfkesslllellkel<br>ddknsgqnkidysvaaefikrdienlydvfreqirslgiaeyykadmisdcflctcglefaly<br>spknslmpafknvykrganlnkayirdkgpketgdqgqnsykaleeyreltwyievknn<br>dqsynayknllqliyyhaflpevrenealitdfinrtkewnrketeerintknnkkhknfde<br>ndditvntyryesipdyqgeslddylkvlqrkqmarakevnekeegnnnyiqfirdvvv<br>wafgaylenklknyknelqpplskenigIndtlkelfpeekvkspfnikerfsistfidnkg<br>kstdntsaeavktdgkedekdkknikrkdllcfylflrlldeneicklqhqfikyrcslkerrf<br>pgnrtkleketellaeleelmelvrftmpsipeisakaesgydtmikkyflcdfiekkvfknp<br>ktsnlyyhsdsktpvtrkymallmrsaplhlykdifkgyylitkkecleyiklsniikdyqn<br>slnelheqleriklksekqngkdslyldkkdfykykeyvenleqvarykhlqhkinfesly<br>rifrihvdiaarmvgytqdwerdmhflflcalvyngvleerrfeaifnnnddnndgrivkki<br>qnnlnnknrelvsmlcwnkklnknefgaiiwkrnpiahlnhftqteqnsksslesIinslri<br>llaydrkrqnavtktindlllndyhirikwegrvdegqiyfnikekedienepiihlkhlhkk<br>dcyiyknsymfdkqkewicngikeevydksilkcignifldyedknkssanpkht |
| EreC2c2 | *Eubacterium rectale* (SEQ ID NO: 18) | mlrrdkevkklynvfnqiqvgtkpkkwnndeklspeenerraqqknikmknykwrea<br>cskyvessqriindvifysyrkaknklrymrknedilkkmqeaeklskfsggkledfvayt<br>lrkslvvskydtqefdslaamvvflecigknnisdhereivcklllelirkdfskldpnvkgsq<br>ganivrsvrnqnmivqpqgdrflfpqvyakenetvtnknvekeglneflllnyanlddekr<br>aeslrklrrildvyfsapnhyekdmditlsdnieekekfnvwekhecgkketglfvdipdvl<br>meaeaenikldavvekrerkvindrvrkqniicyrytravvekynsneplffennainqy<br>wihhienaverilknckagklfklrkgylaekvwkdainlisikyialgkavynfalddiw<br>kdkknkelgivderirngitsfdyemikahenlqrelavdiafsvnnlaravcdmsnlgnk<br>esdfllwkrndiadklknkddmasysavlqffggksswdinifkdaykgkkkynyevrf<br>iddlrkaiycarnenfhfktalvndekwntelfgkiferetefclnvekdrfysnnllymfyq<br>vselrnmldhlysrsysraaqvpsynsvivrtafpeyitnvlgyqkpsydadtlgkwysac<br>yyllkeiyynsflqsdralqlfeksvktlswddkkqqravdnfkdhfsdiksactslaqvcq<br>iymteynqqnnqikkvrssndsifdqpvyqhykyllkkaianafadylknnkdlfgfigk<br>pfkaneireidkeqflpdwtsrkyealcievsgKielqkwyivgkflnarslnlmvgsmrs<br>yiqvvtdikrraasignelhvsvhdvekvekwvqvieveslasrtsnqfedyfndkddy<br>arylksyvdfsnvdmpseysalvdfsneeqsdlyvdpknpkvnrnivhsklfaadhilrd<br>ivepvskdnieefysqkaeiayckikgkeitaeeqkavlkyqklknrvelrdiveygeiine<br>llgqlinwsfmrerdllyfqlgfhydclrndskkpegyknikvdensikdailyqiigmyv<br>ngvtvyapekdgdklkeqcvkggvgvkvsafhryskylglnektlynagleifevvaeh<br>ediinlrngidhfkyylgdyrsmlsiysevfdrfftydikyqknvlnllqnillrhnvivepil<br>esgfktigeqtkpgaklsirsiksdtfqykvkggtlitdakderyletirkilyyaeneednlk<br>ksvvvtnadkyeknkesddqnkqkekknkdnkgkkneetksdaeknnnerlsynpfa<br>nlnfklsn |
| EbaC2C2 | *Eubacteriaceae bacterium* CHKCI004 (SEQ ID NO: 19) | mkiskeshkrtavavmedrvggvvyvpggsgidlsnnlkkrsmdtkslynvfnqiqagt<br>apseyewkdylseaenkkreaqkmiqkanyelrrecedyakkanlavsriifskkpkkif<br>sddddiishmkkqrlskfkgrmedfvlialrkslvvstynqevfdsrkaatvflknigkknis<br>adderqikqlmaliredydkwnpdkdssdkkessgtkvirsiehqnmviqpeknklsls<br>kisnvgkktktkqkekagldaflkeyaqidensrmeylkklrrlldtyfaapssyikgaavs<br>lpeninfsselnvwerheaakkvninfveipeslnaeqnnnkinkveqehsleqlrtdirrr<br>nitcyhfanalaaderyhtlffenmamnqfwihhmenaverilkkenvgtlfldrigylse<br>kvwkdmlnllsikyialgkavyhfalddiwkadiwkdasdknsgkindltlkgissfdye<br>mvkaqedlqremavgvafstnnlarvtckmddlsdaesdfllwnkeairrhvkytekge<br>ilsailqffggrslwdeslfekaysdsnyelkflddlkraiyaarnetfhfktaaidggswntrl<br>fgslfekeaglclnveknkfysnnlvlfykqedlrvfldklygkecsraaqipsyntilprksf<br>sdfmkqllglkepvygsaildqwysacyylfkevyynlflqdssakalfekavkalkgad<br>kkqekavesfrkryweisknaslaeicqsyiteynqqnnkerkvrsandgmfnepiyqh<br>ykmllkealkmafasyikndkelkfvykptekIfevsqdnflpnwnsekyntlisevkns<br>pdlqkwyivgkfmnarmlnllgsmrsylqyvsdiqkraaglgenqlhlsaenvgqvkk<br>wiqvlevelllsvrisdkftdyfkdeeeyasylkeyvdfedsampsdysallafsnegkidl<br>yvdasnpkvnrniiqaklyapdmvlkkvvkkisqdeckefnekkeqimqfknkgdev<br>sweeqqkileyqklknrvelrdseygelinellgqlinwsylrerdllyfqlgfhysclmne<br>skkpdayktirrgtvsienavlyqiiamyingfpvyapekgelkpqcktgsagqkirafcq<br>wasmvekkkyelynaglelefevvkehdniidlrnkidhfkyyqgndsilalygeifdrfft |

TABLE 5-continued

| | | |
|---|---|---|
| | | ydmkyrnnvinhlqnillrhnviikpiiskdkkevgrgkmkdraaflleevssdrftykvk<br>egerkidaknrlyletvrdilyfpnravndkgedviicskkaqdlnekkadrdknhdkskd<br>tnqkkegknqeeksenkepysdrmtwkpfagikle |
| C2c2<br>NK4A144 | *Lachno-<br>spiraceae<br>bacterium*<br>NK4A144<br>(SEQ ID<br>NO: 20) | mkiskvdhtrmavakgnqhrrdeisgilykdptktgsidfderfkklncsakilyhvfngi<br>aegsnkykniviidkvnnnldrvlftgksydrksiididtvlrnvekinafdristeereqiiddl<br>leiqlrkglrkgaglrevlligagvivrtdkkqeiadfleildedfnktnqakniklsienqgl<br>vvspvsrgeerifdvsgaqkgksskkaqekealsaflldyadldknvrfeylrkirrlinlyf<br>yvknddvmslteipaevnlekdfdiwrdheqrkeengdfvgcpdilladrdvkksnskq<br>vkiaerqlresireknikryrfsiktiekddgtyffankqisvfwihrienaverilgsindkkl<br>yrlrlgylgekvwkdilnflsikyiavgkavfnfamddlqekdrdiepgkisenavngltsf<br>dyeqikademlqrevavnvafaannlarvtvdipqngekedillwnksdikkykknskk<br>gilksilqffggastwnmkmfeiayhdqpgdyeenylydiiqiiyslrnksfhflaydhgd<br>knwnreligkmiehdaervisverekfhsnnlpmfykdadlkkildllysdyagrasqvp<br>afntylvrknfpeflrkdmgykvhfnnpevenqwhsavyylykeiyynlflrdkevknlf<br>ytslkrnirsevsdkkqklasddfasrceeiedrslpeicqiimteynaqnfgnrkvksqrvie<br>knkdifrhykmlliktlagafslylkqerfafigkatpipyettdvknflpewksgmyasfy<br>eeiknnldlqewyivgrflngrmlnqlagslrsyiqyaedierraaenrnklfskpdekiea<br>ckkavrvldlcikistrisaeftdyfdseddyadylekylkyqddaikelsgssyaaldhfcn<br>kddlkfdiyvnagqkpilqrnivmaklfgpdnilsevmekvtesaireyydylkkvsgyr<br>vrgkcstekeqedllkfqrlknavefrdvteyaevinellgqliswsylrerdllyfqlgfhy<br>mclknksfkpaeyvdirrnngtiihnailyqivsmyingldfyscdkegktlkpietgkgv<br>gskigqfikysqylyndpsykleiynaglevfenidehdnitdlrkyvdhfkyyaygnkm<br>slldlyseffdrfftydmkyqknvvnvlenillrhfvifypkfgsgkkdvgirdckkeraqi<br>eiseqsltsedfmfklddkageeaakfparderylqtiakllyypneiedmnrfmkkgeti<br>nkkvqfnrkkkitrkqknnssnevlsstmgylfknikl |
| C2c2<br>Chloro_<br>agg | RNA-<br>binding<br>protein S1<br>*Chloroflexus<br>aggregans*<br>(SEQ ID<br>NO: 21) | mtdqvrreevaageladtplaaaqtpaadaavaatpapaeavaptpeqavdqpattgese<br>apvttaqaaaheaepaeatgasfttpvseqqpqkprrlkdlqpgmelegkvtsialygifvd<br>vgvgrdglvhisemsdrridtpselvqigdtvkvwyksvdldarrisltmlnpsrgekprr<br>srqsqpaqpqprrqevdreklaslkvgeivegvitgfapfgafadigvgkdglihiselseg<br>rvekpedavkvgeryqfkvleidgegtrislslrraqrtqrmqqlepsgqiiegtvsgiatfga<br>fvdigvgrdglvhisalaphrvakvedvvkvgdkvkvkvlgvdpqskrisltmrleeeqp<br>attagdeaaepaaeevtptrrgnlerfaaaaqtarersergersergerrerrerrpaqsspdtyi<br>vgedddesfegnatiedllltkfggsssrrdrdrrrrheddddeemerpsnrrqreairrtlqqi<br>gyde |
| C2c2<br>Dem_Aur | *Demequina<br>aurantiaca*<br>(SEQ ID<br>NO: 22) | mdltwhallilfivallagfldtlaggggllltvpallltgippplqalgtnklqssfgtgmatyqvi<br>rkkrvhwrdvrwpmvwaflgsaagavavqfidtdalliiipvvlalvaayflfvpkshlpp<br>peprmsdpayeativpiigaydgafgpgtgslyalsgvalraktivqcstaiaktlnfatnfaal<br>lvfafaghmlwtvgavmiaggligayagshmlfrvnplvlrvlivvmslgmlirvild |
| C2c2<br>Thal_Sp<br>TSL5 | *Thalassospira*<br>sp. TSL5-<br>1<br>(SEQ ID<br>NO: 23) | mriikpygrshvegvatqeprrklrinsspdisrdipgfaqshdaliiaqwisaidkiatkpk<br>pdkkptqaqinlrttlgdaawqhvmaenllpaatdpaireklhliwqskiapwgtarpqa<br>ekdgkptpkggwyerfcgvlspeaitqnvarqiakdiydhlhvaakrkgrepakqgess<br>nkpgkfkpdrkrglieeraesiaknalrgspghapcpwgpddqatyeqagdvagqiyaaa<br>rdcleekkrrsgnrntssvqylprdlaakilyaqygrvfgpdttikaaldeqpslfalhkaikd<br>cyhrlindarkrdilrilprnmaalfrlvraqydnrdinalirlgkvihyhaseqgksehhgir<br>dywpsqqdiqnsrfwgsdgqadikrheafsriwrhiialasrtlhdwadphsqkfsgend<br>dilllakdaieddvfkaghyerkedvlfgaqaslfcgaedfekailkqaitgtgnlrnatfhfk<br>gkvrfekelqeltkdvpvevqsaiaalwqkdaegrtrqiaetlqavlaghflteeqnrhifaa<br>ltaamaqpgdvplprlrrvlarhdsicqrgrilplspcpdrakleespaltcqytvlkmlydg<br>pfrawlaqqnstilnhyidstiartdkaardmngrklaqaekdlitsraadlprlsvdekmg<br>dflarltaatatemrvqrgyqsdgenaqkqaafigqfecdvlgrafadflnqsgfdfvlklka<br>dtpqpdaaqcdvtaliapddisysppqawqqvlyfilhlvpvddashllhqirkwqvleg<br>kekpaqiandvqsvlmlyldmhdakftggaalhgiekfaeffahaadfravfppqslqdq<br>drsiprrglreivrfghlpllqhmsgtvqithdnvvawqaartagatgmspiarrqkqreel<br>halavertarfrnadlqnymhalvdvikhrqlsaqvtlsdqvrlhrlmmgvlgrlvdyagl<br>werdlyfvvlallyhhgatpddvfkgqgkknladgqvvaalkpnrkaaapvgvfddld<br>hygiyqddrqsirnglshfnmlrggkapdlshwvnqtrslvandrklknavaksviemla<br>regfdldwgiqtdrgqhilshgkirtrqaqhfqksrlhivkksakpdkndtvkirenlhgda<br>mvervvqlfaaqvqkryditvekrldhlflkpqdqkgngihthngwsktekkrrpsren<br>rkgnhen |
| C2c2_<br>Pseudo_sp | *Pseudobutyr<br>ivibrio* sp.<br>OR37<br>(SEQ ID<br>NO: 24) | mkfskeshrktavgvtesngiigllykdpinekekiedvvnqranstkrlfnlfgteatskdi<br>sraskdlakvvnkaignikgnkkfnkkeqitkglntkiiveelknvlkdekklivnkdiide<br>acsrllktsfrtaktkqavkmiltavlientnlskedeafvfkrfvkklvneyneyktsvkkqip<br>valsnqnmviqpnsvngtleisetkksketkttekdafraflyrdyatldenrrhkmrlclrnl<br>vnlyfygetsvskddfdewrdhedkkqndelfvkkivsiktdrkgnvkevldvdatidai<br>rtnniacyrralayanenpdvffsdtmlnkfwihhveneveriiyghinnntgdykyqlgy<br>lsekvwkgiinylsikyiaegkavynyamnalakdnnsnafgkldekfvngitsfeyeri<br>kaeetlqrecavniafaanhlanatvdlnekdsdfllllkhednkdtlgavarpnilrnilqffg<br>gksrwndfdfsgideiqlllddlrkmiyslrnssfhfktenidndswntkligdmfaydfn<br>magnvqkdkmysnnvpmfystsdiekmldrlyaevherasqvpsfnsvfvrknfpdy<br>lkndlkitsafgvdalkwqsavyyvckeiyyndflqnpetfftmlkdvyqclpididksm<br>dqklksernahknfkeafatyckecdslsaicqmimteynnqnkgnrkvisartkdgdkl<br>iykhykmilfealknvftiyleknintygflkkpklinnvpaieeflpnyngrqyetlynrit<br>eetelqkwyivgrllnpkqvnqlignfrsyvqyvndvarrakqtgnnlsndniawdvkni<br>iqifdvaklngvtsniledyfddgddyarylknfvdytnknndhsatllgdfcakeidgiki<br>giyhdgtnpivnrniiqcklygatgiissdltkdgsilsvdyeiikkymqmkeikvyqqk |

TABLE 5-continued

| | | |
|---|---|---|
| | | gicktkeeqqnlkkygelknivelrnidyseildelqgqlinwgylrerdlmyfqlgfhyl
clhneskkpvgynnagdisgavlyqivamytnglslidangkskknakasagakvgsfc
syskeirgvdkdtkedddpiylagvelfeninehqqcinlrnyiehfhyyakhdrsmldly
sevfdrfftydmkytknvpnmmynillqhlvvpafefgssekrlddndeqtkpramfttlr
eknglsseqftyrlgdgnstvklsargddylravaslllyypdrapeglirdaeaedkfakinh
snpksdnrnnrgnfknpkvqwynnktkrk |
| C2c2_Buty_
sp | *Butyrivibrio
sp.*
YAB3001
(SEQ ID
NO: 25) | mkiskvdhrktavkitdnkgaegfiyqdptrdsstmeqiisnrarssskvlfnifgdtkkskd
lnkytesliiyvnkaikslkgdkrnnkyeeitesklktervinaliqagneftcsenniedalnk
ylkksfrvgntksalkkllmaaycgyklsieekeeignyfvdklykeynkdtvlkytaksl
khqnmvvqpdtdnhvflpsriagatqnkmsekealteflkayavldeekrhnlriilrklv
nlyfyespdfiypennewkehddrknktetfvspvkvneekngktfvkidvpatkdlirl
kniecyrrsvaetagnpityftdhniskfwihhienevekifallksnwkdyqfsvgyisek
vwkeiinylsikyiaigkavynyaledikkndgtlnfgvidpsfydginsfeyekikaeetf
qrevavyvsfavnhlssatvklseaqsdmlvinkndiekiaygntkrnilqffggqskwk
efdfdryinpvnytdidflfdikkmvyslrnesfhftttdtesdwnknlisamfeyecrrist
vqknkffsnnlplfygenslervlhkyddyvdrmsqvpsfgnvfvrkkfpdymkeigi
khnlssednlklqgalyflykeiyynafissekamkifvdlynkldtnarddkgritheam
ahknfkdaishymthdcsladicqkimteynqqntghrkkqttysseknpeifrhykmil
fmllqkamteyisseeifdfimkpnspktdikeeeflpqykscaydnlikliadnvelqkw
yitarllsprevngligsfrsykqfvsdierraketnnslsksgmtvdvenitkvldlctklngr
fsneltdyfdskddyavyvskfldfgfkidekfpaallgefcnkeengkkigiyhngtepil
nsniikslygitdvvsravkpvseklireylqqevkikpylengvcknkeeqaalrkyqe
lknriefrdiveyseiinelmgqlinfsylrerdlmyfqlgfhylclnnygakpegyysivn
dkrtikgailyqivamytyglpiyhyvdgtisdrknkktvldtlnssetvgakikyfiyysd
elfndslilynaglelfeninehenivnlrkyidhfkyyvsqdrsllidysyevfdryftydrky
kknymnlfsnimlkhfiitdfefstgekntigekntakkecakvrikrgglssdkftykfkda
kpielsakntefldgvarilyypenvvltdlvrnsevedekriekydrnhnssptrkdktyk
qdvkknynkktskafdsskldtksvgnnlsdnpvlkqflseskkkr |
| C2c2_
Blautia_
sp | *Blautia sp.*
Marseille-
P2398
(SEQ ID
NO: 26) | mkiskvdhvksgidqklssqrgmlykqpqkkyegkqleefivrnlsrkakalyqvfpvs
gnskmekelqiinsfiknillrldsgktseeivgyintysvasqisgdhiqelvdqhlkeslrk
ytcvgdkriyvpdiivallkskfnsetlqydmselkilidfiredylkekqikqivhsiennst
plriaeinggkrlipanvdnpkksyifelfkeyaqsdpkgqesllqhmrylillylygpdkit
ddyceeieawnfgsivmdneqlfseeasmliqdriyvnqqieegrqskdtakvkknksk
yrmlgdkiehsinesvvkhyqeackaveekdipwikyisdhvmsvyssknrvdldklsl
pylakntwntwisfiamkyvdmgkgvyhfamsdvdkvgkqdnliigqidpkfsdgis
sfdyerikaeddlhrsmsgyiafavnnfaraicsdefrkknrkedvltvgldeiplydnykr
kllqyfggasnwddsiidiiddkdlvacikenlyvarnvnfhfagsekvqkkqddileeiv
rketrdigkhyrkvfysnnvavfycdediiklmnhlyqrekpyqaqipsynkvisktylp
dlifmllgknrtkisdpsimnmfrgtfyfllkeiyyndflqasnlkemfceglknnvknk
ksekpyqnfmrrfeelenmgmdfgeicqqimtdyeqqnkqkkttatavmsekdkkir
tldndtqkykhfrtllyiglreafiiylkdeknkewyeflrepvkreqpeekefvnkwklnq
ysdcselilkdslaaawyvvahfinqaqlnhligdiknyiqfisdidrrakstgnpvsestei
qieryrkilrvlefakffcggqitnyltdyyqdendfsthvghyvkfekknmepahalqafs
nslyacgkekkkagfyydgmnpivnrnitlasmygnkkllenamnpvteqdirkyysl
maeldsvlkngavcksedeqknlrhfqnlknrielvdvltlselvndlvaqligwvyirerd
mmyqlglhyiklyftdsvaedsylrtldleegsiadgavlyqiaslysfnlpmyvkpnks
svyckkhvnsvatkfdifekeycngdetvienglrlfeninlhkdmvkfrdylahfkyfak
ldesilelyskaydfffsynilkksysyvltnyllsyfinaklsfstykssgnktvqhrttkis
vvaqtdyftyklrsivknkngvesiendrrcevvniaardkefvdevcnvinynsdk |
| C2c2_
Lepto_sp_
Marseille | *Leptotrichia
sp.*
Marseille-
P3007
(SEQ ID
NO: 27) | mkitkidgishkkyikegklykstseenktderlselltirldtyiknpdnaseeennrirrrenl
keffsnkvlylkdgilylkdrreknqlqnknyseediseyllknknnflvlkkillnedinse
eleifrndfekkldkinslkysleenkanyqkinennikkvegkskrnifynyykdsakrn
dyinniqeafdklykkedienlffliensskkhekykirecyhkiigrkndkenfatiiyeeiq
nvnnmkeliekvpnvselkksqvfykyylnkeklndenikyvfchfveiemskllkny
vykkpsnisndkvkrifeyqslkklienkllnkldtyvrncgkysfylqdgeiatsdfivgn
rqneaflrniigvsstayfslrniletenenditgrmrgktvknnkgeekyisgeidklydnn
kqnevkknlkmfysydfnmnskkeiedffsnideaissirhgivhfnlelegkdiftflcni
vpsqiskkmfhdeinekklklkifkqlnsanyfrylekykilnylnrtrfefvnknipfvpsf
tklysriddlknslgiywktpktnddnktkeitdaqiyllkniyygeflnyfmsnngnffeit
keiielnkndkrnlktgfyklqkfenlqektpkeylaniqslyminagnqdeeekdtyidfi
qkifikgfmtylanngrlsliyigsdeetntslaekkqefdkflkkyeqnnnieipyeinefv
reiklgkikylyterlnmfylilkllnhkeltnlkgslekyqsankeeafsdqleliniilnldnnr
vtedfeleadeigkfldfngnkvkdnkelkkfdtnkiyfdgeniikhrafynikkygmlnl
lekisdeakykisieelknyskkkneieenhttgenlhrkyarprkdekftdedykkyeka
irniqqythlknkvefnelnllqsillrilhrlvgytsiwerdlrfrlkgefpenqyieeifnfdn
sknvykngqivekyinfykelykddtekisiysdkkvkelkkekkdlyirnyiahfnyi
pnaeisilemlenlrkilsydrklknaimksivdilkeygfvvtflciekdkkirieslkseev
vhlkklklkdndkkkepiktyrnskelcklvkvmfeykmkekksen |
| C2c2_
Bacter-
oides_
ihuae | *Bacteroides
ihuae*
(SEQ ID
NO: 28) | mritkvkvkessdqkdkmvlihrkvgegtivldenladltapiidkykdksfelsllkqtiv
sekemnipkcdkctakerclsckgkrekrlkevrgaiektigaviagrdiiprinifnedeic
wlikpkirnefftfkdvnkqvvklnlpkvlveyskkndptiflayqqwiaaylknkkghik
ksilnnrvvidysdesklsrkrkqalelwgeeyetnqriaLesyhtsynigelvtlipnpeeyv
sdkgeirpafhyklknvlqmhqstvfgtneilcinpifnenraniqlsaynlevvkyfehyf
pikkkknlslnqaiyylkvetlkerlslqlenalrmnllqkgkikkhefdkntcsntlsqik
rdeffvinlvemcafaannrirnivdkeqvneilskkdlcnslskntidkelcctkfygadfsqi
pvaiwamrgsvqqirneivhykaeaidkiflaktfeyddmekdysdtpfkqylelsieki |

TABLE 5-continued

| | | |
|---|---|---|
| | | dsffieqlqssndvinyyctedvnkllnkcklslrrtsipfapgfktiyelgchlqdssntyrigh<br>ylmliggrvanstvtkaskaypayrfmlkliynhlflnkfldnhnkrffmkavafvlkdnr<br>enarnkfqyafkeirmmnndesiasymsyihslsvqeqekkgdkndkvryntekfiek<br>vfvkgfddflswlgvefilspnqeerdktvtreeyenlmikdrvehsinsnqeshiafftfc<br>klldanhlsdlrnewikfrssgdkegfsynfaidiielclltvdrveqrrdgykeqtelkeyls<br>ffikgnesentvwkgfyfqqdnytpvlyspielirkygtlellkliivdedkitqgefeewqt<br>lkkvvedkvtrrnelhqewedmknkssfsqekcsiyqklcrdidrynwldnklhlvhlrk<br>lhnlviqilsrmarfialwdrdfvlldasranddykilsffnfrdfinakktktddellaefgsk<br>iekknapfikaedvplmvecieakrsfyqkvffrnnlqvladrnfiahynyisktakcslfe<br>miiklrtimyydrklrnavvksianvfdqngmvlqlslddshelkvdkviskrivhlknn<br>nimtdqvpeeyykicrrllemkk |
| C2c2_<br>Porph_<br>bacterium | Porphyromo<br>nadaceae<br>bacterium<br>KH3CP3RA<br>(SEQ ID<br>NO: 29) | mefrdsiflcsllqkeiekaplcfaeklisggvfsyypserlkefvgnhpfslfrktmpfspgf<br>krvmksggnyqnanrdgrfydldigvylpkdgfgdeewnaryflmkliynqlflpyfad<br>aenhlfrecvdfvkrvnrdyncknnnseeeqafidirsmredesiadylafiqsniiieenkk<br>ketnkegqinfnkflllqvfvkgfdsflkdrtelnflqlpelqgdgtrgddlesldklgavvav<br>dlkldatgidadlnenisfytfckildsnhlsrlrneiikyqsansdfshnedfdydriisiielc<br>mlsadhvstndnesifpnndkdfsgirpylstdakvetfedlyvhsdaktpitnatmvlnw<br>kygtdklferlmisdqdflvtekdyfvwkelkkdieekiklreelhslwvntpkgkkgak<br>kkngrettgefseenkkeylevcreidryvnldnklhfvhlkrmhsllielgrfvgftylfer<br>dyqyyhleirsrrnkdagvvdkleynkikdqnkydkddffactflyekankvrnfiahfn<br>yltmwnspqeeehnsnlsgaknssgrqnlkcsltelinelrevmsydrklknavtkavidl<br>fdkhgmvikfrivnnnnndnknkhhlelddivpkkimhlrgiklkrqdgkpipiqtdsv<br>dplycrmwkklldlkptpf |
| C2c2_<br>Listeria_<br>riparia | Listeria<br>riparia<br>(SEQ<br>NO: 30) | mhdawaenpkkpqsdaflkeykacceaidtynwhknkativyvnelhhllidilgrlvg<br>yvaiadrdfqcmanqylkssghtervdswintirknrpdyiekldifmnkaglfvsekng<br>lDrnyiahlnylspkhkysllylfeklremlkydrklknavtkslidlldkhgmcvvfanlknn<br>khrlviaslkpkkietfkwkkik |
| C2c2_<br>insolitis_<br>peregrinum<br>(SEQ ID<br>NO: 31) | Insolitispir-<br>illum<br>peregrinum | mriirpygsstvaspspqdaqpirslqrqngtfdvaefsrrhpelvlaqwvamldkiirkpa<br>pgknstalprptaeqrrlrqqvgaalwaemqrhtpvppelkavwdskvhpyskdnapat<br>aktpshrgrwydrfgdpetsaatvaegvrrhlldsaqpfranggqpkgkgviehraltiqn<br>gtllhhhqsekagplpedwstyradelvstigkdarwikvaaslyqhygrifgpttpiseaq<br>trpefvlhtavkayyrrlfkerklpaerlerllprtgealrhavtvqhgnrsladavrigkilhy<br>gwlqngepdpwpddaalyssrywgsdgqtdikhseaysrvwrraltaaqrtltswlypa<br>gtdagdilligqkpdsidrnflpllygdstrhwtrspgdvwlflkqtlenlrnssfhflalsaft<br>shldgtcesepaeqqaaqalwqddrqqdhqqvflslraldattylptgplhrivnavqstda<br>tlplprfrrvvtraantrlkgfpvepvnrrtmeddpllrcrygvlklllyergfrawletrpsias<br>cldqslkrstkaaqtingknspqgveilsratkllqaegggghgihdlfdrlyaataremrvq<br>vgyhhdaeaarqqaefiedlkcevvarafcaylktlgiqgdtfrrqpeplptwpdlpdlpss<br>tigtaqaalysvlhlmpvedvgsllhqlrrwlvalqarggedgtaitatiplllelylnrhdakf<br>sgggagtglrwddwqvffdcqatfdrvfppgpaldshrlplrglrevlrfgrvndlaaligq<br>dkitaaevdrwhtaeqtiaaqqqrrealheqlsrkkgtdaevdeyralvtaiadhrhltahvt<br>lsnvvrlhrlmttvlgrlvdygglwerdltfvtlyeahrlgglrnllsesrvnkfldgqtpaals<br>kknnaeengmiskylgdkarrqirndfahfnmlqqgkktinitdeinnarklmandrklk<br>naitrsvttllqqdgldivwtmdashrltdakidsrnaihlhkthnranireplhgksycrwv<br>aalfgatstpsatkksdkir |

In an embodiment of the invention, there is provided effector protein which comprises an amino acid sequence having at least 80% sequence homology to the wild-type sequence of any of Leptotrichia shahii C2c2, Lachnospiraceae bacterium MA2020 C2c2, Lachnospiraceae bacterium NK4A179 C2c2, Clostridium aminophilum (DSM 10710) C2c2, Carnobacterium gallinarum (DSM 4847) C2c2, Paludibacter propionicigenes (WB4) C2c2, Listeria weihenstephanensis (FSL R9-0317) C2c2, Listeriaceae bacterium (FSL M6-0635) C2c2, Listeria newyorkensis (FSL M6-0635) C2c2, Leptotrichia wadei (F0279) C2c2, Rhodobacter capsulatus (SB 1003) C2c2, Rhodobacter capsulatus (R121) C2c2, Rhodobacter capsulatus (DE442) C2c2, Leptotrichia wadei (Lw2) C2c2, or Listeria seeligeri C2c2.

In an embodiment of the invention, the effector protein comprises an amino acid sequence having at least 80% sequence homology to a Type VI effector protein consensus sequence including but not limited to a consensus sequence described herein According to the invention, a consensus sequence can be generated from multiple C2c2 orthologs, which can assist in locating conserved amino acid residues, and motifs, including but not limited to catalytic residues and HEPN motifs in C2c2 orthologs that mediate C2c2 function. One such consensus sequence, generated from the 33 orthologs mentioned above using Geneious alignment is:

(SEQ ID NO: 32)
mkiskvxxxvxkkxxxgklxkxvnernrxakrlsnxlbkyixxidkixkk exxkkfxaxeeit1klnqxxxbxlxkaxxdlrkdnxysxjkkilhnedin xeexellindxleklxkiesxkysyqkxxxnyxmsvqehskksixrixes akrnkealdkflkeyaxldprmexlaklrkllelyfyfkndxixxeeexn vxxhkxlkenhpdfvexxxnkenaelnxyaiexkkjlkyyfpxkxaknsn dkifekqelkkxwihqjenaverillxxgkvxyklqxgylaelwkirine ifikyixvgkavaxfalmxxkbendilggkixkklngitsfxyekikaee ilqrexavevafaanxlyaxdlxxirxsilqffggasnwdxflffhfats xisdkkwnaelixxkkjglvireklysnnvamfyskddlekllnxlxxfx lrasqvpsfkkvyvrxbfpqnllkkfndekddeaysaxyyllkeiyynxf lpyfsannxfffxvknlvlkankdkfxxafxdiremnxgspieylxxtqx nxxnegrkkeekexdfikfllqifxkgfddylknnxxfilkfipeptexi -continued

```
eixxelqawyivgkflnarkxnllgxfxsylklllddielralrnenikyq ssnxekevlexcleligllsldlndyfbdexdfaxyjgkxldfekkxmkd laelxpydqndgenpivnrnixlakkygtlnllekjxdkvsekeikeyye lkkeieeyxxkgeelheewxqxknrvexrdileyxeelxgqiinynxlxn kvllyfqlglhyllldilgrlvgytgiwerdaxlyqiaamyxnglpeyix xkkndkykdgqivgxkinxfkxdkkxlynaglelfenxnehknixirnyi ahfnylskaessllxysenlrxlfsydrklknavxkslinillrhgmvlk fldgtdkksvxirsxkkixhlksiakklyypevxvskeycklvkxllkyk
```

In another non-limiting example, a sequence alignment tool to assist generation of a consensus sequence and identification of conserved residues is the MUSCLE alignment tool (ebi.ac.uk/Tools/msa/muscle/). For example, using MUSCLE, the following amino acid locations conserved among C2c2 orthologs can be identified in *Leptotrichia wadei* C2c2: K2; K5; V6; E301; L331; I335; N341; G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

An exemplary sequence alignment of HEPN domains showing highly conserved residues is shown in FIG. 50

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, a N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molcel.2016.12.023, and U.S. Provisional Application No. to be assigned, entitled "Novel Cas13b Orthologues CRISPR Enzymes and System" filed Mar. 15, 2017. In particular embodiments, the Cas13b enzyme is derived from *Bergeyella zoohelcum*. In certain other example embodiments, the effector protein is, or comprises an amino acid sequence having at least 80% sequence homology to any of the sequences listed in Table 6.

TABLE 6

| | | |
|---|---|---|
| *Bergeyella zoohelcum* | 1 (SEQ ID NO: 33) | menktsignniyynpfkpqdksyfagyfnaamentdsvfrelgkrlkgkeytsenffdaifkeni slveyeryvkllsdyfpmarlldkkevpikerkenfkknfkgiikavrdlrnfythkehgeveitde ifgvldemlkstvltvkkkkvktdktkeilkksiekqldilcqkkleylrdtarkieekrrnqrerge kelvapfkysdkrddliaaiyndafdvyidkkkdslkesskakyntksdpqqeegdlkipiskng vvfilslfltkqeihafkskiagfkatvideatvseatvshgknsicfmatheifshlaykklkrkvrta einygeaenaeqlsvyaketlmmqmldelskvpdvvyqnlsedvqktfiedwneylkenngd vgtmeeeqvihpvirkryedkfnyfairfldefaqfpflrfqvhlgnylhdsrpkenlisdrrikekit vfgrlselehkkalfikntetnedrehyweifpnpnydfpkenisvndkdfpiagsildrekqpva gkigikvkllnqqyvsevdkavkahqlkqrkaskpsiqniieeivpinesnpkeaivfggqptayl smndihsilyeffdkwekkkeklekkgekelrkeigkelekkivgkiqaqiqqiidkdtnakilk pyqdgnstaidkeklikdlkqeqnilqklkdeqtvrekeyndfiayqdknreinkvrdrnhkqyl kdnikrkypeaparkevlyyrekgkvavwlandikrfmptdfknewkgeqhsllqkslayyeq ckeelknllpekvfqhlpfklggyfqqkylyqfytcyldkfleyisglvqqaenfksenkvfkkve necfkfikkqnythkeldarvqsilgypiflergfmdekptiikgktfkgnealfadwfryykeyq nfqtfydtenyplvelekkqadrkrktkiyqqkkndvifilmakhifksvfkqdsidqfsledlyqs reerlgnqerarqtgerntnyiwnktvdlklcdgkitvenvklknvgdfikyeydqrvqaflkyee niewqaflikeskeeenypyvvereiegyekvrreellkevhlieeyilekvkdkeilkkgdnqnf kyyilngllkqlknedvesykvfnintepedvninqlkqeatdleqkafvltyirnkfahnqlpkk efwdycqekygkiekektyaeyfaevflckekealik |
| *Prevotella intermedia* | 2 (SEQ ID NO: 34) | meddkkttdsiryelkdkhfwaafinlarhnvyitvnhinkileegeinrdgyettikntwneikdi nkkdrlskliikhfpfleaatyrinptdttkqkeekqaeaqsleslrksffvflyklrdlrnhyshykh skslerpkfeegllekmynifnasirlykedyqynkdinpdedflchldrteeefnyyftkdnegni tesglllffvslflekkdaiwmqqklrgfkdnrenkkkmtnevfcrsrmllpklrlqstqtqdwilld mlnelircpkslyerlreedrekfrvpieiadedydaeqepflcntivrhqdrfpyfalryfdyneift nlrfqidlgtyhfsiykkqigdykeshhlthklygferiqeftkqnrpdewrkfvktfnsfetskepy ipettphyhlenqkigirfrndndkiwpslktnseknekskykldksfqaeaflsvhellpmmfy ylllktentdndneietkkkenkndkqekhkieeiienkiteiyalydtfangeiksideleeyckg kdieighlpkqmiailkdehkvmateaerkqeemlvdvqkslesldnqineeienverknsslks gkiaswlyndmmrfqpvqkdnegkpinnskansteyqllqrtlaffgseherlapyfkqtkliess nphpflkdtewekcnnilsfyrsyleakknflesLkpedweknqyflklkepktkptivqgwk ngfnlprgiftepirkwfmkhrenitvaelkrvglvakviplffseeykdsvqpfynyhfnvgnin kpdeknfinceerrellrkkkdefkkmtdkekeenpsylefkswnkferelrlvrnqdivtwllc melfnkkkikelnvekiylknintnttkkeknteekngeeknikeknnilnrimpmrlpikvygr enfsknkkkkirrntfftvyieekgtkllkqgnfkalerdrrlgglfsfvktpskaesksntisklrvey elgeyqkarieiikdmlalektlidkynsldtdnfnkmltdwlelkgepdkasfqndvdlliavrna fshnqypmrnriafaninpfslssantseekglgianqlkdkthktiekiieiekpietke |
| *Prevotella buccae* | 3 (SEQ ID NO: 35) | mqkqdklfvdrkknaifafpkyitimenkekpepiyyeltdkhfwaaflnlarhnvyttinhinrr leiaelkddgymmgikgswneqakkldkkvrlrdlimkhfpfleaaayemtnskspnnkeqre keqsealslnnlknvlfifleklqvlrnyyshykyseespkpifetsllknmykvfdanvrlvkrdy mhhenidmqrdfthlnrkkqvgrtkniidspnfhyhfadkegnmtiagllffvslfldkkdaiw mqkklkgflcdgrnlreqmtnevfcrsrislpklklenvqtkdwmqldmlnelvrcpkslyerlre kdresfkvpfdifsddynaeeepfkntivrhqdrfpyfvlryfdlneifeqlrfqidlgtyhfsiynkr |

TABLE 6-continued

| | | |
|---|---|---|
| | | igdedevrhlthhlygfariqdfapqnqpeewrklykdldhfetsqepyisktaphyhlenekigi kfcsahnnlfpslqtdktengrskfnlgtqftaeaflsvhellpmmfyylllltkdysrkesadkvegi irkeisniyaiydafanneinsiadltrrlqntnilqghlpkqmisilkgrqkdmgkeaerkigemi ddtqrrldllckqtnqkirigkrnagllksgkiadwlyndmmrfqpvqkdqnnipinnskanste yrmlqralalfgsenfrlkayfnqmnlvgndnphpflaetqwehqtnilsfyrnyleakrrkkylkgl kpqnwkqyqhfllilkvqktnrntivtgwknsfnlprgiftqpirewfekhnnskriydqilsfdry gfvakaiplyfaeeykdnvqpfydypfnignrlkpkkredkkervelwqknkelfknypsek kktdlayldflswkkferelrlliknqdivtwlmflcelfnmatveglkigeihlrdidtntaneesnni lnrimpmklpvktyetdnkgnilkerplatfyieetetkvlkqgnfkalvkdrringlfsfaettdlnl eehpisklsvdlelikyqttrisifemtlglekklidkystlptdsfrnmlerwlqckanrpelknyvn sliavrnafshnqypmydatlfaevkkftlfpsvdtkkielniapqlleivgkaikeiekseknkn |
| Porphyromonas gingivalis | 4 (SEQ ID NO: 36) | mntvpasenkgqsrtveddpqyfglylnlarenlieveshvrikfgkkklneesllkqsllcdhllsv drwtkvyghsrrylpflhyfdpdsqiekdhdsktgvdpdsaqrlirelyslldflrndfshnrldgttf ehlevspdissfitgtyslacgraqsrfavffkpddfvlaknrkeqlisvadgkecltvsgfafficlfl dreqasgmlsrirgfkrtdenwaravhetfcdlcirhphdrlessntkeallldmlnelnrcprilyd mlpeeeraqflpaldensmnnlsensldeesrllwdgssdwaeealtkrirhqdrfpylmlrfieem dllkgirfrvdlgeieldsyskkvgrngeydrtitdhalafgklsdfqneeevsrmisgeasypvrfs lfapryaiydnkigychtsdpvypksktgekralsnpqsmgfisvhdlrklllmellcegsfsrmq sdflrkanrildetaegklqfsalfpemrhrfippqnpkskdrrekaettlekyqkeikgrkdklnsq llsafdmdqrqlpsrlldewmnirpashsvklrtyvkqlnedcrlrlrkfrkdgdgkaraiplvge matflsqdivrmiiseetkklitsayynemqrslaqyageenrrqfraivaelrlldpssghpflsat metahrytegfykcylekkrewlakifyrpeqdentkrrisvffvpdgearkllpllirrrmkeqnd lqdwirnkqahpidlpshlfdskvmellkykdgkkkwneafkdwwstkypdgmqpfyglrr elnihgksysyipsdgkkfadcythlmektvrdkkrelrtagkpvppdlaadikrsfhravneref mlrlvqeddrlmlmainkmmtdreedilpglknidsildeenqfslavhakvlekegeggdnsl slvpatieikskrkdwskyiryrydrrvpglmshfpehkatldevktllgeydrcrikifdwafale gaimsdrdlkpylhesssregksgehstivkmlvekkgcltpdesqyliliirnkaahnqfpcaae mpliyrdvsakvgsiegssakdlpegsslvdslwkkyemiirkilpildpenrffgkllnnmsqpi ndl |
| Bacteroides pyogenes | 5 (SEQ ID NO: 37) | mesiknsqkstgktlqkdppyfglylnmallnyrkvenhirkwlgdvallpeksgfhsllttdnlss akwtrfysksrkflpflemfdsdkksyenrretaecldtidrqkissllkevygklqdirnafshyhi ddqsvkhtaliissemhrfienaysfalqktrarftgvfvetdflqaeekgdnkkffaiggnegiklk dnalificlfldreeafkflsratgflcstkekgflavretfcalccrqpherllsvnpreallmdmlnel nrcpdilfemldekdqksflpllgeeeqahilenslndelceaiddpfemiaslskrvryknrfpyl mlryieeknllpfirfridlgclelasypkkmgeennyersvtdhamafgrltdfhnedavlqqitk gitdevrfslyapryaiynnkigfvrtsgsdkisfptlkkkggeghcvaytlqntksfgfisiydlrkil llsfldkdkaknivsglleqcekhwkdlsenlfdairtelqkefpvpliryltlprskggklvssklad k qekyeseferrkekllteilsekdfdlsqiprrmidewlnvlptsrekklkgyvetlkldcrerlrvfek rekgehplpprigematdlakdiirmvidqgvkqritsayyseiqrclaqyagddnrrhldsiirelr lkdtknghpflgkvlrpglghteklyqryfeekkewleatfypaaspkrvprfvnpptgkqkelpl iirnlmkerpewrdwkqrknshpidlpsqlfeneicrllkdkigkepsgklkwnemfklywdk efpngmqrfyrckrrvevfdkvveyeyseeggnykkyyealidevvrqkisssskekskqlvedl tlsvrrvflcrainekeyqlrllceddrllfmavrdlydwkeaqldldkidnmlgepvsysqviqleg gqpdavikaecklkdvsklmrycydgrvkglmpyfanheatqeqvemelrhyedhrrrvfnw vfaleksvlkneklifyeesqggcehrrcidalrkaslvseeeyeflvhirnksahnqfpdleigkl ppnvtsgfceciwskykaiicriipfidperrffgklleqk |
| Alistipes sp. ZOR0009 | 6 (SEQ ID NO: 38) | msneigafrehqfayapgneekqeeatfatyfnlalsnvegmmfgevesnpdkieksldtlppail rqiasfiwlskedhpdkaysteevkvivtdlvrrlcfyrnyfshcfyldtqyfysdelvdttaigeklp ynfhhfitnrlfryslpeitlfrwnegerkyeilrdgliffcclflkrgqaerflnelrffkrtdeegrikrti ftkyctreshkhigieeqdflifqdiigdlnrvpkvcdgvvdlskeneryiknretsnesdenkaryr llirekdkfpyylmryivdfgvlpcitfkqndystkegrgqfhyqdaavageercynfvvrngnv yysympqaqnvvriselqgtisveelrnmvyasingkdvnksveqlylhllyekiltisgqtik egrvdvedyrplldklllrpasngeelrrelrkllpkrvcdllsnrfdcsegvsavekrlkailllrheqll lsqnpalhidkiksvidylylffsddekfrqqptekahrglkdeefqmyhylvgdydshplalwk eleasgrlkpemrklltsatslhglymlclkgtvewcrkqlmsigkgtakveaiadrvglklydklk eytpeqlerevklvvmhgyaaaatpkpkaqaaipskltelrfysflgkremsfaafirqdkkaqkl wlrnfytveniktlqkrqaaadaackklynlvgevervhtndkvlvlvaqryrerllnvgskcavtl dnperqqkladvyevqnawlsirfddldftlthvnlsnlrkaynliprkhilafkeylndnrvkqklc eecrnvrrkedlctccsprysnitswlkenhsessiereaatmmlldverkllsfllderrkaiieygk fipfsalvkecrladaglcgirndvlhdnvisyadaigklsayfpkeaseaveyirrtkevreqrreel manssq |
| Prevotella sp. MA2016 | 7a (SEQ ID NO: 39) | mskeckkqrqekkrrlqkanfsisltgkhvfgayfnmartnfvktinyilpiagvrgnysenqink mlhalfliqagrneelttteqkqwekklrinpeqqtkfqklllflchfpvlgpmmadvadhkaylnk kkstvqtedetfamlkgvsladcldiiclmadtltecrnfythkdpynkpsqladqylhqemiakk ldkvvvasrrilkdreglsvnevefltgidhlhqevlkdefgnakvkdgkvmktfveyddfyflcis gkrlvngytvttkddkpvnvntmlpalsdfgllyfcvlflskpyaklfidevrlfeyspfddkenmi msemlsiyrirtprlhkidshdskatlamdifgelrrcpmelynlldknagqpffhdevkhpnsht pdvskrlryddrfptlalryidetelfkrirfqlqlgsfrykfydkencidgrvrvrriqkeingygrm qevadkrmdkwgdliqkreersvkleheelyinldqfledtadstpyvtdrrpaynihanrigly wedsqnpkqykvfdengmyipelvvtedkkapikmpaprcalsvydlpamlfyeylreqqdn efpsaeqvliieyeddyrkffkavaegklkfrpkefrdflkkeypklrmadipkklqlflcshglc ynnkpetvyerldrltlqhleerelhiqnrlehyqkdrdmignkdnqygkksfsdvrhgalaryla qsmmmewqptklkdkekghdkltglnynyltaylatyghpqvpeegftprtleqvlinahliggsn phpfinkvlalgnrnieeelylhyleeeelkhirsriqlssnpsdkalsalpfihhdrmryhertseem malaaryttiqlpdglftpyileilqkhytensdlqnalsqdvpvklnptcnaaylitlfyqtvlkdna qpfylsdktytrnkdgekaesfsfkrayelfsvinnnkkdtfpfemiplflftsdeigerlsakllddgd |

TABLE 6-continued

| | | |
|---|---|---|
| | | gnpvpevgekgkpatdsqgntiwkrriysevddyaekltdrdmkisfkgeweklprwkqdkii krrdetrrqmrdellqrmpryirdikdnertlrryktqdmvlflllaekmftniiseqssefnwkqmr lskvcneaflrqtltfrvpvtvgettiyveqenmslknygefyrfltddrlmsllnnivetlkpneng dlvirhtdlmselaaydqyrstifmliqsienliitnnavlddpdadgfwvredlpkrnnfaslllelin qlnnveltdderkllvairnafshnsynidfslikdvkhlpevakgilqhlqsmlgveitk |
| *Prevotella sp.* MA2016 | 7b (SEQ ID NO: 40) | mskeckkqrqekkrrlqkanfsisltgkhvfgayfnmartnfvktinyilpiagvrgnysenqink mlhalfliqagrneelttteqkqwekkhinpeqqtkfqkllflchfpvlgpmmadvadhkaylnk kkstvqtedetfamlkgvsladcldiiclmadtltecrnfythkdpynkpsqladqylhqemiakk ldkvvvasrrilkdreglsvneveflltgidhlhqevlkdefgnakvkdgkvmktfveyddfyfkis gkrlvngytvttkddkpvnvntmlpalsdfgllyfcvlflskpyaklfidevrlfeyspfddkenmi msemlsiyrirtprlhkidshdskatlamdifgebrcpmelynlldknagqpffhdevkhpnsht pdvskrlryddrfptlalryidetelfkrirfqlqlgsfrykfydkencidgrvrvrriqkeingygrm qevadkrmdkwgdliqkreersvkleheelyinldqfledtadstpyvtdrrpaynihanrigly wedsqnpkqykvfdengmyipelvvtedkkapikmpaprcalsvyddlpamlfyeylreqqdn efpsaeqviieyeddyrkffkavaegklkpfkrpkefrdflkkeypklrmadipkklqlflcshglc ynnkpetvyerldrltlqhleerelhiqnrlehyqkdrdmignkdnqygkksfsdvrhgalaryla qsmmewqptklkdkekghdkltglnynyltaylatyghpqveegftprtleqvlinahliggsn phpfinkvlalgnrnieelylhyleeelkhirsriqslssnpsdkalsalpfihhdrmryhertseem malaaryttiqlpdglftpyileilqkhytensdlqnalsqdvpvklnptcnaaylitlfyqtvlkdna qpfylsdktytrnkdgekaesfsfkrayelfsvinnnkkdtfpfemiplfltsdeigerlsaklldgd gnpvpevgekgkpatdsqgntiwkrriysevddyaekltdrdmkisfkgeweklprwkqdkii krrdetrrqmrdellqrmpryirdikdnertlrryktqdmvlflllaekmftniiseqssefnwkqmr lskvcneaflrqtltfrvpvtvgettiyveqenmslknygefyrfltddrlmsllnnivetlkpneng dlvirhtdlmselaaydqyrstifmliqsienliitnnavlddpdadgfwvredlpkrnnfaslllelin qlnnveltdderkllvairnafshnsynidfslikdvkhlpevakgilqhlqsmlgveitk |
| *Riemerella anatipestifer* | 8 (SEQ ID NO: 41) | mekpllpnvytlkhkffwgaflniarhnafiticihineqlglktpsnddkivdvvcetwnnilnnd hdlllkksqlteliliilkhfpfltamcyhppkkegkkkghqkeqqkekeseaqsqaealnpsklieale ilvnqlhslrnyyshykhkkpdaekdifkhlykafdaslrmvkedykahftvnitrdfahlnrkgk nkqdnpdfnryrfekdgfftesgllfftnlfldkrdaywmlkkvsgfkashkqrekmttevfcrsri llpkblesrydhnqmlldmlselsrcpkllyekldseenkkhfqveadgfldeieeeqnpfkdtlirh qdrfpyfalrylddlnesfksirfqvdlgtyhyciydkkigdeqekrhltrtllsfgrlqdfteinrpqew kaltkdldykettsnqpfiskttphyhitdnkigfrlgtskelypsleikdganriakypynsgfvaha fisvhellplmfyqhltgksedlllketvrhiqriykdfeeerintiedlekanqgflplgafpkqmlgl lqnkqpdlsekakikiekliaetklllshrintklksspklgkrrekliktgvladwlvkdfmrfqpva ydaqnqpiksskanstefwfirralalyggeknrlegyfkqtnligntnphpflnkfnwkacrnlv dfyqqylegekfleaiknqpwepyqyclllkipkenrknlvkgweqggislprglfteairetlse dlmlskpirkeikkhgrvgfisraitlyfkekyqdkhqsfynlsykleakapllkreehyeywqqn kpqsptesqrlelhtsdrwkdyllykrwqhlekklrlyrnqdvmlwlmtteltknhfkelnlnyh qlklenlavnvqeadaklnpinqtlpmvlpvkvypatafgevqyhktpirtvyireehtkalkmg nfkalvkdrringlfsfikeendtqkhpisqlrlrreleiyqslrvdafketlsleekllnkhtslsslene fralleewkkeyaassmvtdehiafiasvrnafchnqypfykealhapiplfltvaqptteekdglgi aeallkvlreyceivksqi |
| *Prevotella aurantiaca* | 9 (SEQ ID NO: 42) | meddkkttgsisyelkdkhfwaaflnlarhnvyitinhinklleireidndekvldiktlwqkgnk dlnqkarlrelmtkhfpfletaiytknkedkkevkqekqaeaqsleslkdclflfldklqearnyys hykysefskepefeegllekmynifgnniqlvindyqhnkdinpdedfkhldrkgqfkysfadn egnitesgllffvslflekkdaiwmqqklngfkdnlenkkkmthevfcrsrilmpklrlestqtqd willdmlnelircpkslyerlqggdrekfkvpfdpadedynaeqepfkntlirhqdrfpyfvlryfd yneifknlrfqidlgtyhfsiykkliggqkedrhlthklygferiqefakqnrpdewkaivkdldty etsnkryisettphyhlenqkigirfrngnkeiwpslktndennekskykldkqyqaeaflsvhell pmmfyylllkkekpnndeinasivegfikreirnifklydafangeinniddlekycadkgiprkh lpkqmvailydehkdmvkeakrkqkemvkdtkklllatlekqtqkekeddgrnvklllksgeiar wlyndmmrfqpvqkdnegkpinnskansteyqmlqrslalynneekptryfrqvnliesnnph pflkwtkweecnnniltfyysyltkkieflnklkpedwkknqyflklkepktnretivqgwkngfn lprgiftepirewfkrhqnnskeyekvealdrvglvtkvipllfkeeyfkdkeenfkedtqkeindc vqpfynfpynvgnihkpkekdflhreerielwdkkkdkfkgykekikskkltekdkeefrsylef qswnkferelrlvrnqdivtwllckelidklkidelnieelkklrinnidtdtakkeknnilnrvmp melppvtvyeiddshkivkdkplhtiyikeaetkllkqgnfkalvkdrringlfsfvktnseaeskrn pisklrveyelgeyqearieiiqdmlaleeklinkykdlptnkfsemlnswlegkdeadkarfqnd vdfliavrnafshnqypmhnkiefanikpfslytannseekglgianqlkdktkettdkikkiekpi etke |
| *Prevotella saccharolytica* | 10 (SEQ ID NO: 43) | medkpfwaaffnlarhnvyltvnhinklldleklydegkhkeiferedifnisddvmndansng kkrkldikkiwddltdtlrkyqlrelilkhfpfiqpaiigaqtkerttidkdkrststsndslkqtgeg dindlllslsnyksmffrllqileqlrnyyshvkhsksatmpnfdedllnwmryifidsvnkvkedy ssnsvidpntsfshliykdeqgkikperypftskdgsinafgllffvslflekqdsiwmqkkipgfk kasenymkmtnevfcrnhillpkirletvydkdwmlldmlnevvrcplslykrltpaaqnkfkv pekssdnanrqeddnpfsrilvrhqnrfpyfvlrffdlnevfttlrfqinlgcyhfaickkqigdkke vhhlirtlygfsrlqnftqntrpeewntivkttepssgndgktvqgvplpyisytiphyqienekigi kifdgdtavdtdiwpsvstekqlnkpdkytltpgfkadvflsvhellpmmfyygillcegmlktd agnavekvlidtrnaifnlydafvqekintitdlenylqdkpilighlpkqmidllkghqrdmlkav eqkkamlikdterrlklldkqtetdvaakntgtllknggqiadwlvndmmrfqpvkndkegnp incskansteyqmlqrafafyatdscrlsryftqlhlihsdnshlflsrfeydkqpnliafyaaylkak leflnelqpqnwasdnyflllrapkndrqkleagwkngfnlprglftekiktwfnehktivdisdcd ifknrvgqvarlipvffdkkfkdhsqpfyrydfnvgnvskpteanylskgkreelfksyqnkflai nipaekkeyreyknfslwkkferelrliknqdiliwlmcknlffdekikpkkdileprialaysyikld slqtntstagslnalakvvpmtlaihidspkpkgkagnnekenkeftvyikeegtkllkwgnflctll |

TABLE 6-continued

| | | |
|---|---|---|
| | | adrrikglfsyiehddidlkqhpltkrrvdleldlyqtcridifqqtlgleaqlldkysdlntdnfyqml<br>igwrkkegiprnikedtdflkdvrnafshnqypdskkiafrrirkfnpkelileeeeglgiatqmyk<br>evekvvnrikrielfd |
| HMPREF9712_<br>03108<br>[*Myroides*<br>*odoratimimus*<br>CCUG<br>10230] | 11<br>(SEQ ID<br>NO: 44) | mkdilttdttekqnrfyshkiadkyffggyfnlasnniyevfeevnkrntfgklakrdngnlknyii<br>hvfkdelsisdfekrvaifasyfpiletvdkksikernrtidltlsqrirqfremlislvtavdqlrnfyth<br>yhhsdivienkvldflnssfvstalhvkdkylktdktkeflketiaaeldilieaykkkqiekkntrfk<br>ankredilnaiyneafwsfindkdkdketvvakgadayfeknhhksndpdfalnisekgivy<br>llsffltnkemdslkanitgfkgkvdresgnsikymatqriysfhtyrglkqkirtseegvketllmq<br>midelskvpnvvyqhlsttqqnsfiedwneyykdyeddvetddlsrvihpvirkryedrfnyfai<br>rfldeffdfptlrfqvhlgdyvhdrrtkqlgkvesdriikekvtvfarlkdinsakasyfhsleeqdke<br>eldnkwtlfpnpsydfpkehtlqhqgeqknagkigiyvklrdtqykekaaleearkslnpkersat<br>kaskydiitqiieandnyksekplvftgqpiaylsmndihsmlfslltdnaelkktpeeveaklidq<br>igkqineilskdtdtkilkkykdndlketdtdkitrdlardkeeieklileqkqraddynytsstkfni<br>dksrkrkhllfnaekgkigvwlandikrfmflceskskwkgyqhtelqklfayfdtsksdlelilsn<br>mvmvkdypielidlykksrtivdflnkylearleyienvitrvknsigtpqflavrkecftflkksny<br>tvvsldkqverilsmplfiergfmddkptmlegksykqhkekfadwfvhykensnyqnfydte<br>vyeittedkrekakvtkkikqqqkndvifimmvnymleevlklssndrlslnelyqtkeerivnk<br>qvakdtgernknyiwnkvvdlqlcdglvhidnvklkdignfrkyendsrvkeflltyqsdivwsa<br>ylsnevdsnklyvierqldnyesirskellkevqeiecsvynqvankeslkqsgnenfkqyvlqgl<br>lpigmdvremlilstdvkfkkeeiiqlgqagevqedlysliyirnkfahnqlpikeffdfcennyrsi<br>sdneyyaeyymeifrsikekyan |
| *Prevotella*<br>*intermedia* | 12<br>(SEQ ID<br>NO: 45) | meddkkttdsiryelkdkhfwaaflnlarhnvyitvnhinkileedeinrdgyentlenswneikd<br>inkkdrlskliikhfpfleattyrqnptdttkqkeekqaeaqslesIkksffvflyklrdlrnhyshyk<br>hskslerpkfeedlqnkmynifdvsiqfvkedykhntdinpkkdflchldrkrkgkfhysfadne<br>gnitesgllffvslflekkdaiwvqkklegflccsnksyqkmtnevfcrsrmllpklrlestqtqdwil<br>ldmlnelircpkslyerlqgvnrkkfyvsfdpadedydaeqepflcntivrhqdrfpyfalryfdyn<br>evfanlrfqidlgtyhfsiykkliggqkedrhlthklygferiqefdkqnrpdewkaivkdsdifick<br>keekeeekpyisettphyhlenkkigiafknhniwpstqteltnnkrkkynlgtsikaeaflsvhell<br>pmmfyylllkkentkndnkvggkkketkkqgkhkieaiieskikdiyalydafangeinsedelke<br>ylkgkdikivhlpkqmiailknehkdmaekaeakqekmklatenrlktldkqlkgkiqngkry<br>nsapksgeiaswlyndmmrfqpvqkdengeslnnskansteyqllqrtlaffgseherlapyfkq<br>tkliessnphpflndtewekcsnilsfyrsylkarknfleslkpedweknqyflmlkepktnretiv<br>qgwkngfnlprgfftepirkwfmehwksikvddlkrvglvakvtplffsekykdsvqpfynypf<br>nvgdynkpkeedflhreerielwdkkkdkflcgykakkkfkemtdkekeehrsylefqswnkf<br>erelrlyrnqdivtwllctelidklkidelnikelkklrlkdintdtakkeknnilnrvmpmelpvtv<br>ykynkggyiiknkplhtiyikeaetkllkqgnfkalvkdrringlfsfvktpseaesesnpisklrve<br>yelgkyqnarldiiedmlalekklidkynsldtdnfhnmltgwlelkgeakkarfqndvklltavr<br>nafshnqypmydenlfgnierfslsssniieskgldiaaklkeevskaakkiqneednkkeket |
| *Capnocyto-*<br>*phaga*<br>*canimorsus* | 13<br>(SEQ ID<br>NO: 46) | mkniqrlgkgnefspfkkedkfyfggflnlannniedffkeiitrfgivitdenkkpketfgkeilne<br>ifkkdisivdyekwvnifadyfpftkylslyleemqfknrvicfrdvmkellktvealrnfythyd<br>hepikiedrvfyfldkvildvsltvknkylktdktkeflnqhigeelkelckqrkdylvgkgkridk<br>eseiingiynnaflcdfickrekqddkenhnsvekilcnkepqnkkqkssatvwelcsksssykte<br>ksfpnrendkhclevpisqkgivfllsifinkgeiyaltsnikgflcakitkeepvtydknsirymath<br>rmfsflaykglkrkirtseinynedgqasstyeketlmlqmldelnkvpdvvyqnlsedvqktfie<br>dwneylkenngdygtmeeeqvihpvirkryedkfnyfairfldefaqfptlrfqvhlgnylcdkrt<br>kqicdttterevkkkitvfgrlselenkkaiflnereeikgwevfpnpsydfpkenisvnykdfpiv<br>gsildrekqpvsnkigirvkiadelqreidkaikekklrnpknrkanqdekqkerlvneivstnsne<br>qgepvvfigqptaylsmndihsvlyeflinkisgealetkivekietqikqiigkdattkilkpytna<br>nsnsinreklldleqeqqilkttlleeqqqrekdkkdkskrkhelypsekgkvavwlandikrf<br>mpkafkeqwrgyhhsllqkylayyeqskeelknllpkevflchfpfklkgyfqqqylnqfytdyl<br>krrlsyvnelllniqnfkndkdalkatekecfldfrkqnyiinpiniqiqsilvypiflkrgfldekpt<br>midrekflcenkdteladwfmhyknykednyqkfyayplekveekekflunkqinkqkkndv<br>ytlmmveyiiqkifgdkfveenplvlkgifqskaerqqnnthaattqernlngilnqpkdikiqgk<br>itvkgvlkldignfrkyeidqrvntfldyeprkewmaylpndwkekekqgqlpppnnvidrqis<br>kyetvrskillkdvqelekiissdeikeehrhdlkqgkyynfkyyilngllrqlknenvenykvfkln<br>tnpekvnitqlkqeatdleqkafvltyirnkfahnqlpkkefwdycqekygiekekektyaeyfae<br>vfkrekealik |
| *Porphyromonas*<br>*gulae* | 14<br>(SEQ ID<br>NO: 47) | mteqserpyngtyytledkhfwaaflnlarhnayitlthidrqlayskaditndqdvlsflcalwknf<br>dndlerksrlrslilkhfsflegaaygkklfesksssgnksskneltkkekeelqanalsldnlksilfd<br>flqklkdfrnyyshyrhsgsselplfdgnmlqrlynvfdvsvqrvkidhehndevdphyhfnhlv<br>rkgkkdryghndnpsflchhfvdgegmvteagllffvslflekrdaiwmqkkirgflcggtetyqq<br>mtnevfcrsrislpklkleslrmddwmlldmlnelvrcpkplydrlreddracfrvpvdilpdeed<br>tdgggedpfkntivrhqdrfpyfalryfdlkkvftslrfhidlgtyhfaiykkmigeqpedrhltrnl<br>ygfgriqdfaeehrpeewkrlyrdldyfetgdkpyisqtsphyhiekgkiglrfmpegqhlwpsp<br>evgttrtgrskyaqdkrltaeaflsvhelmpmmfyfllrekyseevsaervqgrikrviedvyav<br>ydafardeintrdeldacladkgirrghlprqmiailsqehkdmeekirkklqemmadtdhrld<br>mldrqtdrkirigrknaglpksgviadwlvrdmmrfqpvakdasgkpinnskansteyrmlqra<br>lalfggekerltpyfrqmnitggnnphpflhetrweshtnilsfyrsylrarkaflerigrsdrvenrpf<br>lllkepktdrqtivagwkgefhlprgifteavrdcliemghdevasykevgfmakavplyferace<br>drvgpfydspfnvgnslpkkgrflskeeraeewergkerfrdleawsysaarriedafagieyas<br>pgnkkkieqllrdlslweafesklkvradrinlaklkkeileaqehpyhdfkswqkferelrlyknq<br>diitwmmerdlmeenkvegldtgtlylkdirpnvqeqgslnylnrvkpmrlpvvvyradsrgh<br>vhkeeaplatvyieerdtkllkqgnfksfvkdrringlfsfvdtgglameqyipisklrveyelakyq<br>tarvcvfeltlrleesllltryphlpdesfremleswsdpllakwpelhgkvrlliavrnafshnqypm<br>ydeavfssirkydpsspdaieeermglniahrlseevkqaketveriiqa |

TABLE 6-continued

| | | |
|---|---|---|
| Prevotella sp. P5-125 | 15 (SEQ ID NO: 48) | mnipalvenqkkyfgtysvmamlnaqtvldhiqkvadiegeqnennenlwfhpvmshlyna kngydkqpektmfiierlqsyfpflkimaenqreysngkykqnrvevnsndifevlkrafgvlk myrdltnhyktyeeklndgcefltsteqplsgminnyytvalrnmnerygyktedlafiqdkrfld vkdaygkkksqvntgfflslqdyngdtqkklhlsgvgialliclfldkqyiniflsrlpifssynaqse erriiirsfginsiklpkdrihseksnksvamdmlnevkrcpdelfttlsaekqsrfriisddhnevl mkrssdrfvplllqyidygklfdhirfhvnmgklryllkadktcidgqtrvrvieqpingfgrleeae tmrkqengtfgnsgirirdfenmkrddanpanypyivdtythyilennkvemfindkedsapll pvieddryvvktipscrmstleipamafhmflfgskkteklivdvhnrykrlfqamqkeevtaen iasfgiaesdlpqkildlisgnahgkdvdafirltvddmltdterrikrflcddrksirsadnkmgkrg fkqistgkladflakdivlfqpsyndgenkitglnyrimqsaiavydsgddyeakqqfklmfekar ligkgttephpflykvfarsipanavefyerylierkfyltglsneikkgnrvdvpfirrdqnkwktp amktlgriysedlpvelprqmfdneikshlkslpqmegidfnnanytyliaeymkrvldddfqtf yqwnrnyrymdmlkgeydrkgslqhcftsveeregwlkerasrteryrkqasnkirsnrqmrn asseeietildkrlsnsrneyqksekvirryrvqdallfllakktlteladfdgerfklkeimpdaekgi lseimpmsftfekggkkytitsegmklknygdffvlasdkrignllelvgsdivskedimeefnk ydqcrpeissivfnlekwafdtypelsarvdreekvdflcsilkillnnkninkeqsdilrkirnafdh nnypdkgvveikalpeiamsikkafgeyaimk |
| Flavobacterium branchiophilum | 16 (SEQ ID NO: 49) | menlnkildkeneiciskifntkgiaapitekaldnikskqkndlnkearlhyfsighsflqidtkk vfdyvlieelkdekplkfitlqkdfftkefsiklqklinsirninnhyvhnfndinlnkidsnvfhflk esfelaiiekyykynkkypldneivlflkelfikdentallnyftnlskdeaieyiltftitenkiwnin nehnilniekgkyltfeamlflitiflykneanhllpklydfknnkskqelftffsskkftsqdidaeeg hlikfrdmiqylnhyptawnndlklesenknkimtttklidsiiefelnsnypsfatdiqfkkeakaf lfasnkkrnqtsfsnksyneeirhnphikqyrdeiasaltpisfnvkedkfkifvkkhvleeyfpnsi gyekfleyndftekekedfglklysnpktnklieridnhklykshgrnqdrfmdfsmrflaennyf gkdaffkcykfydtqeqdeflqsnennddvkfhkgkvttyikyeehlknysywdcpfveenns msvkisigseekilkiqrnlmiyflenalynenvenqgyklynnyyrelkkdveesiasldliksn pdfkskykkilpkrilhnyapakqdkapenafetilkkadfreeqykklikkaeheknkedfvkr nkgkqfklhfirkacqmmyfkekyntikegnaafekkdpviekrknkehefghhknlnitreef ndyckwmfafngndsykkylrdlfsekhffdnqeyknlfessvnleafyaktkelfkkwietnk ptnnenrytlenyknlilqkqvfinvyhfskylidknlinsennviqykslenveylisdfyfqskls idqyktcgklfnklksnkledcllyeiaynyidkknvhkidiqkiltskiiltindantpykisvpfn kleryetemiaiknqnnlkarflidlplylsknkikkgkdsagyeiiikndleieidintinnkiindsv kftevlmelekyfilkdkcilskynyidnseipslkqfskywikeneneiinyrniachfhlpfletfd nifinveqkfikeelqnvstindlskpqeylilllfikfichnnfylnlfknesktikndkevkknryl qkfinqvilkkk |
| Myroides odoratimimus | 17 (SEQ ID NO: 50) | mkdilttdttekqnrfyshkiadkyffggyfnlasnniyevfeevnkrntfgklakrdngnlknyii hvfkdelsisdfekrvaifasyfpiletvdkksikernrtidltisqrirqfremlislvtavdqlrnfyth yhhsdivienkvldfinssfvstalhvkdkylktdktkeflketiaaeldiilieaykkkqiekkntrfk ankredilnaiyneafwsfindkdkdkdketvvakgadayfeknhhksndpdfalnisekgivy llsifitnkemdslkanitgfkgkvdresgnsikymatqriysfhtyrglkqkirtseegvketilmq midelskvpvnvyqhlsttqqnsfiedwneyykdyeddvetddlsrvthpvirkryedrfnyfai rfldeffdfpflrfqvhlgdyvhdrrtkqlgkvesdriikekvtvfarlkdinsakasyfhsleeqdke eldnkwtlfpnpsydfpkehtlqhqgeqknagkigiyvklrdtqykekaaleearkslnpkersat kaskydiitqiieandnyksekplvftgqpiaylsmndihsmlfsiltdnaelkktpeeveaklidq igkqineilskdtdtkilkkykdndlketdtdkitrdlardkeeieklileqkqraddynytsstkfni dksrkrkhllfnaekgkigvwlandikrfmfkeskskwkgyqhielqklfayfdtsksdleilsn mvmvkdypielidlvicksrtivdfinkylearleyienvitryknsigtpqflavrkecftflkksny tvvsldkqverilsmplfiergfmddkptmlegksykqhkekfadwfvhykensnyqnfydte vyeittedkrekakvtkkikqqqkndvifimmvnymleevlklssndrislnelyqtkeerivnk qvakdtgernknyiwnkvvdlqlcdglvhidnvklkdignfrkyendsrvkefityqsdivwsa ylsnevdsnklyvierqldnyesirskellkevqeiecsvynqvankeslkqsgnenfkqyvlqgl lpigmdvremlilstdvkfkkeeiiqlgqageveqdlysliyirnkfahnqlpikeffdfcennyrsi sdneyyaeyymeifrsikekyan |
| Flavobacterium columnare | 18 (SEQ ID NO: 51) | mssknesynkqktfnhykqedkyffggfinnaddnlrqvgkeflarinfnhnnnelasvfkdyf nkeksvakrehalnllsnyfpvleriqkhtnhnfeqtreifellldtikklrdyythhyhkpitinpki ydflddtlldvlitikkkkvkndtsrellkeklrpeltqlknqkreelikkgkklleenlenavfnhcli pfleenktddkqnktvslrkyrkskpneetsititqsglvflmsfflhrkefqvftsglerfkakvnti keeeisInkniivymithwsysyynfkglkhriktdqgvstleqnntthsltntntkealltqivdyl skvpneiyetlsekqqkefeedineymrenpenedstfssivshkvirkryenkfnyfamrfide yaelptlrfmvnfgdyikdrqkkilesiqfdseriikkeihlfeklsIvteykknvylketsnidlsrfp lfpnpsyvmannnipfyidsrsnnldeylnqkkkaqsqnkkrnitfekynkeqskdaiiamlqk eigvkdlqqrstigllscnelpsmlyevivkdikgaelenkiaqkireqyqsirdftldspqkdnipt tliktintdssvtfenqpidipriknalqkeltitqeklinvkeheievdnynrnknykfknqpknk vddkklqrkyvfyrneirqeanwlasdlihfmknkslwkgymhnelqsflaffedkkndciall etvfnlkedciltkglknifikhgnfidfykeylklkedflstestflengfiglppkilkkelskrlkyi fivfqkrqfiikeleekknnlyadainlsrgifdekptmipfkknpndefaswfvasyqynnyqsf yeltpdiverdkkkkyknIrainkvkiqdyylklmvdtlyqdlfnqpldkslsdfyvskaerekik adakayqklndssIwnkvihlslqnnritanpklkdigkykralqdekiatlltydartwtyalqkp ekenendykelhytalnmeqeyevrskellkqvqelekkildkfydfsnnashpedleiedkk gkrhpnfklyitkallkneseiinlenidieiillkyydynteelkekiknmdedekakiintkenyn kitnvlikkalvliiirnkmahnqyppkfiydlandvpkkeeeyfatyfnryfetitkelwenkek kdktqv |

TABLE 6-continued

| Porphyromonas gingivalis | 19 (SEQ ID NO: 52) | mtegnekpyngtyytledkhfwaaflnlarhnayitlahidrqlayskaditndedilffkgqwkn ldndlerkarlrslilkhfsflegaaygkklfesqssgnkssskkelskkekeelqanalsldnlksilf dflqklkdfrnyyshyrhpesselplfdgnmlqrlynvfdvsvqrvkrdhehndkvdphrhfnhl vrkgkkdkygnndnpfflchhfvdregtvteagllffvslflekrdaiwmqkkirgfkggteayqq mtnevfcrsrislpklkleslrtddwmlldmlnelvrcpkslydrlreedrarfrvpvdilsdeddtd gteedpfkntivrhqdrfpyfalryfdlkkvftslrfhidlgtyhfaiykknigeqpedrhltrnlygf griqdfaeehrpeewkrlyrdldyfetgdkpyitqttphyhiekgkiglrfvpegqhlwpspevga trtgrskyaqdkrltaeaflsvhelmpmmfyyfllrekyseevsaekvqgrikrviedvyavydaf ardeintrdeldacladkgirrghlprqmiailsqehkdmeekvrkklqemiadtdhrldmldrqt drkirigrknaglpksgvvadwlvrdmmrfqpvakdtsgkpinnskansteyrmlqralalfgg ekerltpyfrqmnitggnnphpflhetrweshtnilsfyrsylearkaflqsigrsdrvenhrifilke pktdrqtivagwkgefhlprgifteavrdcliemgydevgsykevgfmakavplyferaskdry qpfydypfnvgnslkpkkgrflsekeraeewesgkerfrlakllkkeileakehpyhdfkswqkf erelrlryknqdiitwmmerdlmeenkvegldtgtlylkdirtdvqeqgslnvinrvkpmrlpvvv yradsrghvhkeqaplatvyieerdtkllkqgnfksfvkdrringlfsfvdtgalameqypisklry eyelakyqtarvcafeqtleleessllltryphlpdknfrkmleswsdplldkwpdlhgnvrlliavrn afshnqypmydetlfssirkydpsspdaieermglniahrlseevkqakemveriiqa |
| Porphyromonas sp. COT-052 OH4946 | 20 (SEQ ID NO: 53) | mteqserpyngtyytledkhfwaaflnlarhnayitlthidrqlayskaditndqdvlsflcalwknf dndlerksrlrslilkhfsflegaaygkklfeskssgnksskknkeltkkekeelqanalsldnlksilfd flqklkdfrnyyshyrhsesselplfdgnmlqrlynvfdvsvqrvkrdhehndkvdphrhfnhlv rkgkkdryghndnpsflchhfvdsegmvteagllffvslflekrdaiwmqkkirgfkggtetyqq mtnevfcrsrislpklkleslrtddwmlldmlnelvrcpkplydrlreddracfrvpvdilpdeddt dgggedpfkntivrhqdrfpyfalryfdlkkvftslrfhidlgtyhfaiykkmigeqpedrhltrnly gfgriqdfaeehrpeewkrlvrdldyfetgdkpyisqttphyhiekgkiglrfvpegqhlwpspev gttrtgrskyaqdkrltaeaflsvhelmpmmfyyfllrekyseevsaekvqgrikrviedvyaiyd afardeintlkeldacladkgirrghlpkqmigilsgerkdmeekvrkklqemiadtdhrldmldr qtdrkirigrknaglpksgviadwlvrdmmrfqpvakdtsgkpinnskansteyrmlqralalfg gekerltpyfrqmnitggnnphpflhetrweshtnilsfyrsylrarkaflerigrsdrvencpflllk epktdrqtivagwkgefhlprgifteavrdcliemgydevgsyrevgfmakavplyferacedry qpfydspfnvgnslkpkkgrflskedraeewergkerfrdleawshsaarrikdafagieyaspg nkkkieqllrdlslweafesklkvradkinlaklkkeileaqehpyhdflcswqkferelrlyknqdi itwmmerdlmeenkvegldtgtlylkdirpnvqeqgslnylnrvkpmflpvvvyradsrghvh keeaplatvyieerdtkllkqgnfksfvkdrringlfsfvdtgglameqypisklrveyelakyqtar vcvfeltlrleesllsryphlpdesfremleswsdpllakwpelhgkvrlliavrnafshnqypmyd eavfssirkydpsspdaieermglniahrlseevkqaketveriiqa |
| Prevotella intermedia | 21 (SEQ ID NO: 54) | meddkktkestnmldnkhfwaaflnlarhnvyitvnhinkvlelknkkdqdiiidndqdilaikt hwekvngdlnkterlrelmtkhfpfletaiytknkedkeevkqekqakaqsfdslkhclflfleklq earnyyshykysestkepmlekellkkmynifddniqlvikdyqhnkdinpdedflchldrteeee fnyyfttnkkgnitasgllffvslflekkdaiwmqqklrgfkdnresskknskmthevfcrsrmllpklr lestqtqdwilldmlnelircpkslyerlqgeyrkkfnvpfdsadedydaeqepfkntivrhqdrfp yfalryfdyneiftnlrfqidlgtyhfsiykkligqgkedrhlthklygferiqefakqnrtdewkaiv kdfdtyetseepyisetaphyhlenqkigirfrndndeiwpslktngennekrkykldkqyqaeaf lsvhellpmmfyyllkkeepnndkknasivegfikreirdiyklydafangeinniddlekyced kgipkrhlpkqmvailydehkdmaeeakrkqkemvkdtkkllatlekqtqgeiedggrnirllk sgeiarwlvndmmrfqpvqkdnegnpinnskansteyqmlqrslalynkeekptryfrqvnlin ssnphpflkwtkweecnnilsfyrsyltkkieflnklkpedweknqyflklkepktnretivqgw kngfnlprgiftepirewflothqndseeyekvetldrvglvtkviplfflckedskdkeeylkkdaq keinncvqpfygfpynvgnihkpdekdflpseerkklwgdkkykfkgykakvkskkltdkek eeyrsylefqswnkferelrlyrnqdivtwllctelidklkveglnveelkklrlkdidtdtakqekn nilnrympmqlpvtvyeiddshnivkdrplhtvyieetktkllkqgnflcalvkdrringlfsfvdts setelksnpisklsveyelgeyqnarietikdmllleetliekyktlptdnfsdmlngwlegkdead karfqndvkllvavrnafshnqypmrnriafaninpfslssadtseekkldianqlkdkthkiikrii eiekpietke |
| PIN17_0200 [Prevotella intermedia 17] | AFJ07523 (SEQ ID NO: 55) | mkmeddkktkestnmldnkhfwaaflnlarhnvyitvnhinkvlelknkkdqdiiidndqdila ikthwekvngdlnkterlrelmtkhfpfletaiytknkedkeevkqekqakaqsfdslkhclflfle klqearnyyshykysestkepmlekellkkmynifddniqlvikdyqhnkdinpdedflchldrt eeefnyyfttnkkgnitasgllffvslflekkdaiwmqqklrgflcdnresskkmthevfcrsrmll pklrlestqtqdwilldmlnelircpkslyerlqgeyrkkfnvpfdsadedydaeqepflcntivrhq drfpyfalryfdyneiftnlrfqidlgtyhfsiykkliggqkedrhlthklygferiqefakqnrtdew kaivkdfdtyetseepyisetaphyhlenqkigirfrndndeiwpslktngennekrkykldkqy qaeaflsvhellpmmfyyllkkeepnndkknasivegfikreirdiyklydafangeinniddle kycedkgipkrhlpkqmvailydehkdmaeeakrkqkemvkdtkkllatlekqtqgeiedggr nirllksgeiarwlyndmmrfqpvqkdnegnpinnskansteyqmlqrslalynkeekptryfr qvnlinssnphpflkwtkweecnnilsfyrsyltkkieflnklkpedweknqyflklkepktnretl vqgwkngfnlprgiftepirewflothqndseeyekvetldrvglvtkviplfflkkedskdkeeylk kdaqkeinncvqpfygfpynvgnihkpdekdflpseerkklwgdkkykfkgykakvkskklt dkekeeyrsylefqswnkferelrlyrnqdivtwllctelidklkveglnveelkklrlkdidtdtak qeknnilnrvmpmqlpvtvyeiddshnivkdrplhtvyieetktkllkqgnflcalvkdrringlfs fvdtssetelksnpisklsveyelgeyqnarietikdmilleetliekyktlptdnfsdmlngwlegk deadkarfqndvkllvavrnafshnqypmrnriafaninpfslssadtseekkldianqlkdkthk iikriieiekpietke |
| Prevotella intermedia | BAU18623 (SEQ ID NO: 56) | meddkktttdsisyelkdkhfwaaflnlarhnvyitvnhinkvlelknkkdqdiiidndqdilaikt hwekvngdlnkterlrelmtkhfpfletaiysknkedkeevkqekqakaqsfdslkhclflflekl qetrnyyshykysestkepmlekellkkmynifddniqlvikdyqhnkdinpdedfkhldrtee dfnyyftrnkkgnitesgllffvslflekkdaiwmqqklrgfkdnresskkmthevfcrsrmllpk |

TABLE 6-continued

| | | |
|---|---|---|
| | | lrlestqtqdwilldmlnelircpkslyerlqgedrekfkvpfdpadedydaeqepfkntivrhqdr<br>fpyfalryfdyneiftnlrfqidlgtfhfsiykkliggqkedrhlthklygferiqefakqnrpdewka<br>ivkdldtyetsneryisettphyhlenqkigirfrndndeiwpslktngennekskykldkqyae<br>aflsvhellpmmffyylllkkeepnndkknasivegfikreirdmyklydafangeinniddleky<br>cedkgipkrhlpkqmvailydehkdmvkeakrkqrkmvkdteklllaalekqtqektedggrni<br>rllksgeiarwlyndmmrfqpvqkdnegnpinnskansteyqmlqrslalynkeekptryfrqv<br>nlinssnphpflkwtkweeccnnilsfyrsyltkkieflnklkpedweknqyflklkepktnretivq<br>gwkngfnlprgiftepirewflothqndskeyekvealdrvglvtkviplffkkedskdkeedlkk<br>daqkeinncvqpfysfpynvgnihkpdekdflhreerielwdkkkdfkgykakvkskkltdk<br>ekeeyrsylefqswnkferelrlyrnqdivtwllctelidklkveglnveelkklrlkdidtdtakqe<br>knnilnrympmqlpvtvyeiddshnivkdrplhtvyieetktkllkqgnflcalvkdrringlfsfy<br>dtsseaelksnpiskslveyelgeygnarletikdmilleetliekyknlptdnfsdmlngwlegkd<br>eadkarfqndvkllavrnafshnqypmrnriafaninpfslssadtseekkldianqlkdkthkii<br>kriieiekpietke |
| HMPREF6485_<br>0083<br>[Prevotella<br>buccae<br>ATCC<br>33574] | EFU31981<br>(SEQ ID<br>NO: 57) | mqkqdklfvdrkknaifafpkyitimenkekpepiyyeltdkhfwaaflnlarhnvyttinhinrr<br>leiaelkddgymmgikgswneqakkldkkvrlrdlimkhfpfleaaayemtnskspnnkeqre<br>keqsealslnnknvlfiflekklqvlrnyyshykyseespkpifetsllknmykvfdanvrlvkrdy<br>mhhenidmqrdfthlnrkkqvgrtkniidspnfhyhfadkegnmtiagllffvslfldkkdaiw<br>mqkklkgflcdgrnlreqmtnevfcrsrislpklklenvqtkdwmqldmlnelvrcpkslyerlre<br>kdresfkvpfdifsddynaeeepfkntivrhqdrfpyfvlryfdlneifeqlrfqidlgtyhfsiynkr<br>igdedevrhlthhlygfariqdfapqnqpeewrklvkdldhfetsqepyisktaphyhlenekigi<br>kfcsahnnlfpslqtdktcngrskfnlgtqftaeaaflsvhellpmmfyyllltkdysrkesadkvegi<br>irkeisniyaiydafanneinsiadltrrlqntnilqghlpkqmisilkgrqkdmgkeaaerkigemi<br>ddtqrrldllckqtnqkirigkrnagllksgkiadwlvndmmrfqpvqkdqnnipinnskanste<br>yrmlqralalfgsenfrlkayfnqmnlvgndnphpflaetqwehqtnilsfyrnylearkkylkgl<br>kpqnwkkgyqhflilkvqktnrntivtgwknsfnlprgiftqpirewfekhnnskriydqilsfdry<br>gfvakaiplyfaeeykdnvqpfydypfnigrnrlkpkkrqfldkkervelwqknkelfknypsek<br>kktdlayldflswkkferelrliknqdivtwlmflcelfnmatveglkigeihlrdidtntaneesnni<br>lnrimpmklpvktyetdnkgnilkerplatfyieeetetkvlkqgnfkalvkdrringlfsfaettdlnl<br>eehpiskisvdlelikyqttrisifemtlglekklidkystlptdsfrnmlerwlqckanrpelknyvn<br>sliavrnafshnqypmdatlfaevkkftlfpsvdtkkielniapqlleivgkaikeieksenkn |
| HMPREF9144_<br>1146<br>[Prevotella<br>i<br>ATCC<br>700821] | EGQ18444<br>(SEQ ID<br>NO: 58) | mkeeekgktpvvstynkddkhfwaaflnlarhnvyitvnhinkilgegeinrdgyentlekswn<br>eikdinkkdrlskliikhfpflevttyqrnsadttkqkeekqaeaqslesllkksffvfiyklrdlrnhys<br>hykhsksleerpkfeedlqekmynifdasiqlvkedykhntdikteedflchldrkgqfkysfadne<br>gnitesgllffvslflekkdaiwvqkklegflccsnesyqkmtnevfcrsrmllpklrlqstqtqdwil<br>ldmlnelircpkslyerlreedrkkfrvpieiadedydaeqepfknalvrhqdrfpyfalryfdynei<br>ftnlrfqidlgtyhfsiykkqigdykeshhlthklygferiqeftkqnrpdewrkfvktfnsfetske<br>pyiipettphyhlenqkigirfrndndkiwpslktnseknekskykldksfqaeaflsvhellpmm<br>fyyllllktentdndneietkkkenkndkqekhkieeiienkiteiyalydafangkinsidkleeyc<br>kgkdieighlpkqmiailksehkdmateakrkqeemladvqkslesldnqineeienverknssl<br>ksgeiaswlyndmmrfqpvqkdnegnpinnskansteyqmlqrslalynkeekptryfrqvnl<br>iessnphpflnntewekcnnilsfyrsyleaakknfleslkpedweknqyflmlkepktncetivqg<br>wkngfnlprgiftepirkwfmehrknitvaelkrvglvakviplffseeykdsvqpfynylfnvg<br>ninkpdeknflnceerrellckkkdefkkmtdkekeenpsylefqswnkferelrlvrnqdivtwl<br>lcmelfnkkkikelnvekiylknintntttkkeknteekngeekiikeknnilnrimpmrlpikvyg<br>renfsknkkkkirrntfftvyieekgtkllkqgnfkalerdrrlgglfsfvkthskaesksntisksrve<br>yelgeyqkarieiikdmlaleetlidkynsldtdnfhnmltgwlklkdepdkasfqndvdlliavr<br>nafshnqypmrnriafaninpfslssanteekglgianqlkdkthktiekiieiekpietke |
| HMPREF9714_<br>02132<br>[Myroides<br>odoratimimus<br>CCUG<br>12901] | EH008761<br>(SEQ ID<br>NO: 59) | mkdilttdttekqnrfyshkiadkyffggyfnlasnniyevfeevnkrntfgklakrdngnlknyii<br>hvfkdelsisdfekrvaifasyfpiletvdkksikernrtidltlsqrirqfremlislvtavdqlrnfyth<br>yhhseivienkvldflnsslvstalhvkdkylktdktkeflketiaaeldilleaykkkqiekkntrflc<br>ankredilnaiyneafwsfindkdkdketvvakgadayfeknhhksndpdfalnisekgivylls<br>ffltnkemdslkanitgfkgkvdresgnsikymatqriysfhtyrglkqkirtseegvketllmqmi<br>delskvpnvvyqhlsttqqnsfiedwneyykdyeddvetddlsrvihpvirkryedrfnyfairfl<br>deffdfptlrfqvhlgdyvhdrrtkqlgkvesdriikekvtvfarlkdinsakanyfhsleeqdkeel<br>dnkwtlfpnpsydfpkehtlqhqgeqknagkigiyvklrdtqykekaaleearkslnpkersatk<br>askydiitqiieandnvksekplvftgqpiaylsmndihsmlfslltdnaelkktpeeveaklidqi<br>gkqineilskdtdtkilkkykdndlketdtdkitrdlardkeeieklileqkqraddynytsstkfnid<br>ksrkrkhllfnaekgkigvwlandikrfmteefkskwkgyqhtelqklfayydtsksdldlilsdm<br>vmvkdypielialvkksrtivdflnkylearlgymenvitrvknsigtpqflavrkecftflkksnyt<br>vvsldkqverilsmplfiergfmddkptmlegksyqqhkekfadwfvhykensnyqnfydtev<br>yeittedkrekakvtkikqqqknodvftlmmvnymleevlkssndrlslnelyqtkeerivnkq<br>vakdtgernknyiwnkvvdlqlceglvridkvklkdignfrkyendsrvkefltyqsdivwsayl<br>snevdsnklyvierqldnyesirskellkevqeiecsvynqvankeslkqsgnenfkqyvlqglv<br>pigmdvremlilslvdkfikeeiiqlgqagevegqdlysliyirnkfahnqlpikeffdfcennyrsis<br>dneyyaeyymeifrsikekyts |
| HMPREF9711_<br>00870<br>[Myroides<br>odoratimimus<br>CCUG<br>3837] | EKB06014<br>(SEQ ID<br>NO: 60) | mkdilttdttekqnrfyshkiadkyffggyfnlasnniyevfeevnkrntfgklakrdngnlknyii<br>hvfkdelsisdfekrvaifasyfpiletvdkksikernrtidltlsqrirqfremlislvtavdqlrnfyth<br>yhhseivienkvldflnsslvstalhvkdkylktdktkeflketiaaeldilleaykkkqiekkntrfk<br>ankredilnaiyneafwsfindkdkdketvvakgadayfeknhhksndpdfalnisekgivylls<br>ffltnkemdslkanitgfkgkvdresgnsikymatqriysfhtyrglkqkirtseegvketllmqmi<br>delskvpnvvyqhlsttqqnsfiedwneyykdyeddvetddlsrvihpvirkryedrfnyfairfl<br>deffdfptlrfqvhlgdyvhdrrtkqlgkvesdriikekvtvfarlkdinsakasyfhsleeqdkeel<br>dnkwtlfpnpsydfpkehtlqhqgeqknagkigiyvklrdtqykekaaleearkslnpkersatk<br>askydiitqiieandnykseplvftgqpiaylsmndihsmlfslltdnaelkktpeeveaklidqi<br>gkqineilskdtdtkilkkykdndlketdtdkitrdlardkeeieklileqkqraddynytsstkfnid |

TABLE 6-continued

| | | |
|---|---|---|
| | | ksrkrkhllfnaekgkigvwlandikrfmfkeskskwkgyqhtelqklfayfdtsksdlelilsdm<br>vmvkdypielidlyrksrtivdflnkylearlgyienvitrvknsigtpqfktvrkecfaflkesnytv<br>asldkqierilsmplfiergfmdskptmlegksyqqhkedfadwfvhykensnyqnfydtevy<br>eiitedkreqakvtkkikqqqkndvftlmmvnymleevllkpsndrlslnelyqtkeerivnkqv<br>akdtgernknyiwnkvvdlqlceglvridkvklkdignfrkyendsrvkefltyqsdivwsgyls<br>nevdsnklyvierqldnyesirskellkevqeiecivynqvankeslkqsgnenfkqyvlqgllpr<br>gtdvremlilstdvkfkkeeimqlgqvreveqdlysliyirnkfahnqlpikeffdfcennyrpisd<br>neyyaeyymeifrsikekyas |
| HMPREF9699_<br>02005<br>[*Bergeyella*<br>*zoohelcum*<br>ATCC<br>43767] | EKB54193<br>(SEQ ID<br>NO: 61) | menktslgnniyynpfkpqdksyfagyfnaamentdsvfrelgkrlkgkeytsenffdaifkeni<br>slveyeryvkllsdyfpmarlldkkevpikerkenfkknflcgiikavrdlrnfythkehgeveitde<br>ifgvldemlkstvltykkkkvktdktkeilkksiekqldilcqkkleylrdtarkieekrrnqrerge<br>kelvapfkysdkrddliaaiyndafdvyidkkkdslkesskakyntksdpqqeegdlkipiskng<br>vvfllslfltkqeihafkskiagfkatvideatvseatvshgknsicfmatheifshlaykklkrkvrta<br>einygeaenaeqlsvyaketlmmqmldelskvpdvvygnisedvqktfiedwneylkenngd<br>vgtmeeeqvihpvirkryedkfnyfairfldefaqfptlrfqvhlgnylhdsrpkenlisdrrikekit<br>vfgrlselehkkalfikntetnedrehyweifpnpnydfpkenisvndkdfpiagsildrekqpva<br>gkigikvkllnqqyvsevdkavkahqlkqrkaskpsiqniieeivpinesnpkeaivfggqptayl<br>smndihsilyeffdkwekkkeklekkgekelrkeigkelekkivgkiqaqiqqiidkdtnakilk<br>pyqdgnstaidkeklikdlkqeqnilqklkdeqtvrekeyndfiayqdknreinkvrdrnhkqyl<br>kdnlkrkypeaparkevlyyrekgkvavwlandikrfmptdfknewkgeqhsllqkslayyeq<br>ckeelknllpekvfqhlpfklggyfqqkylyqfytcyldkrleyisglvqqaenfksenkvfkkve<br>necfkflkkqnythkeldarvqsilgypiflergfmdekptiikgktfkgnealfadwfryykeyq<br>nfqtfydtenyplvelekkqadrkrktkiyqqkkndvifilmakhifksvfkqdsidqfsledlyqs<br>reerlgnqerarqtgerntnyiwnktvdlklcdgkitvenvklknvgdfikyeydqvrqafikyee<br>niewqaflikeskeeenypyvvereieqyekvrreellkevhlieeyilekvkdkeilkkgdnqnf<br>kyyilngllkqlknedvesykvfnlntepedvninqlkqeatdleqkafvltyirnkfahnqlpkk<br>efwdycqekygkiekektyaeyfaevflckekealik |
| HMPREF9151_<br>01387<br>[*Prevotella*<br>*i*<br>F0055] | EKY00089<br>(SEQ ID<br>NO: 62) | mmekenvqgshiyyeptdkcfwaafynlarhnayltiahinsfvnskkginnddkvldiiddw<br>skfdndlllmgarinklilkhfpflkaplyqlakrktrkqqgkeqqdyekkgdedpeviqeaianaf<br>kmanvrktlhaflkqledlrnhfshynynspakkmevkfddgfcnklyyvfdaalqmvkddnr<br>mnpeinmqtdfehlvrlgrnrkipntfkynftnsdgtinnngllffvslflekrdaiwmqkkikgf<br>kggtenymrmtnevfcrnrmvipklrletdydnhqlmfdmlnelvrcplslykrlkqedqdkfr<br>vpieflddednednpygenansdenpteetdplkntivrhqhrfpyfvlryfdlnevflcqlrfqinl<br>gcyhfsiydktigertekrhltrtlfgfdrlqnfsvklqpehwknmvkhldteessdkpylsdamp<br>hyqienekigihflktdtekketvwpsleveevssnrnkykseknitadaflsthellpmmfyyql<br>lsseektraaagdkvqgvlqsyrkkifdiyddfangtinsmqkldeDerlakdnllrgnmpqqmlail<br>ehqepdmeqkakekldrlitetkkrigkledqflcqkvrigkrradlpkvgsiadwlvndmmrfq<br>pakrnadntgvpdskansteyrllqealafysaykdrlepyfrqvnliggtnphpflhrvdwkken<br>hllsfyhdyleakeqylshlspadwqkhqhfllllkvrkdiqnekkdwkkslvagwkngfnlprg<br>lftesiktwfstdadkvqitdtklfenrvgliakliplyydkvvyndkpqpfyqypfnindrykpedt<br>rkrftaasskklwnekkmlyknaqpdssdkieypqyldflswkklerelrmlrnqdmmvwlmc<br>kdlfaqctvegvefadlklsqlevdvnvqdnlnylnnvssmilplsvypsdaqgnvlrnskplht<br>vyvqenntkllkqgnflcsllkdrringlfsfiaaegedlqqhpltknrleyelsiyqtmrisvfeqtlq<br>lekailtrnktlcgnnfnnllnswsehrtdkktlqpdidfliavrnafshnqypmstntvmqgiekf<br>niqtpkleekdglgiasqlakktkdaasrlqniinggtn |
| A343_1752<br>[*Porphyromonas*<br>*gingivalis*<br>JCVI<br>SC001] | EOA10535<br>(SEQ ID<br>NO: 63) | mteqnekpyngtyytledkhfwaaffnlarhnayitlthidrqlayskaditndedilffkgqwkn<br>lddnlerkarlrsllilkhfsfflegaaygkkllfesqssgnksskkkeltkkeeelqanalsldnlksilf<br>dflqklkdfrnyyshyrhpesselplfdgnmlqrlynvfdvsvqrvkrdhehndkvdphrhfnhl<br>vrkgkkdregnndnpfflchhfvdreekvteagllffvslflekrdaiwmqldcirgfkggtetyqq<br>mtnevfcrsrislpklklesIrtddwmlldmlnelvrcpkslydrlreedrarfrvpvdilsdeddtd<br>gteedpfkntivrhqdrfpyfalryfdlkkvftslrfhidlgtyhfaiykknigeqpedrhltrnlygf<br>griqdfaeehrpeewkrlyrdldyfetgdkpyitqttphyhiekgkiglrfvpegqllwpspevga<br>trtgrskyaqdkrftaeaflsvhelmpmmfyyfllrekyseeasaervqgrikrviedvyavydaf<br>argeidtldrldacladkgirrghlprqmiailsqehkdmeekvrkklqemiadtdhrldmldrqt<br>drkirigrknaglpksgviadwlvrdmmrfqpvakdtsgkpinnskansteyrmlqaralalfgge<br>kerltpyfrqmnitggnnphpflhetrweshtnilsfyrsylkarkaflqsigrsdrvenhrfllllkep<br>ktdrqtivagwkgefhlprgifteavrdcliemgldevgsykevgfmakavplyferackdrvqp<br>fydypfnvgnslkpkkgrflskekraeewesgkerfrdleawshsaarriedafagienasrenkk<br>kieqlldlslwetfesklkvkadkiniaklkkeileakehpyldfkswqkferelrlyknqdiitw<br>mmerdlmeenkvegldtgtlylkdirtdvheqgslnylnrvkpmrlpvvvyradsrghvhkeq<br>aplatvyieerdtkllkqgnflcsfvkdrringlfsfvdtgalameqypisklrveyelakyqtarvca<br>feqtleleesslltryphlpdknfrkmleswsdplldkwpdlhgnvrlliavrnafshnqypmydet<br>lfssirkydpsspdaieermglniahrlseevkqakemveriiqa |
| HMPREF1981_<br>03090<br>[*Bacteroides*<br>*pyogenes*<br>F0041] | ERI81700<br>(SEQ ID<br>NO: 64) | mesiknsqkstgktlqkdppyfglylnmallnyrkvenhirkwlgdvallpeksgfhslltddnlss<br>akwtrfyyksrkflpflemfdsdkksyenrrettecldtidrqkissllkevygklqdirnafshyhi<br>ddqsvkhtaliissemhrfienaysfalqktrarftgvfvetdflqaeekgdnkkffaiggnegiklk<br>dnalificlfldreeafkflsratgflcstkekgflavretfcalccrqpherllsvnpreallmdmlnel<br>nrcpdilfemldekdqksflpllgeeeqahilenslndelceaiddpfemiaslskrvryknrfpyl<br>mlryieeknllpfirfridlgclelasypkkmgeennyersvtdhamafgrltdfhnedavlqqitk<br>gitdevrfslyapryaiynnkigfvrtggsdkisfptlkkkggeghcvaytlqntksfgfisiydlrki<br>lllsfldkdkaknivsglleqcekhwkdllsenlfdairteldykefpvpliryltlprskgkglvssklad<br>kqekyeseferrkekltelsekdfdlsqiprrmidewlnvlptsrekklkgyvetlkldcrerlrvfe<br>krekgehpvpprigematdlakdiirmvidqqvkqritsayyseiqrclaqyagddnrrhldsiir<br>elrrlkdtknghpflgkvlrpglghteklyqryfeekkewleatfypaaspkrvprfvnpptgkqke<br>lpliirnlmkerpewrdwkqrknshpidlpsqlfeneicrllkdkigkepsgklkwnemfklyw<br>dkefpngmqrfyrckrrvevfdkvveyeyseeggnykkyyealidevrqkissskekskqv |

TABLE 6-continued

| | | |
|---|---|---|
| | | edltlsvrrvflcrainekeyqlrllceddrllfmavrdlydwkeaqldldkidnmlgepvsysqviq<br>leggqpdavikaeckldvsklmrycydgrvkglmpyfanheatqeqvemelrhyedhrrrvf<br>nwvfaleksvlkneklif fyeesqggcehrrcidalrkaslvseeeyeflvhirnksahnqfpdlei<br>gklppnvtsgfceciwskykaiicriipfidperrffgklleqk |
| HMPREF1553_<br>02065<br>[*Porphyromonas*<br>*gingivalis*<br>F0568] | ERJ65637<br>(SEQ ID<br>NO: 65) | mntvpasenkgqsrtveddpqyfglylnlarenlieveshvrikfgkkklneeslkqsllcdhllsv<br>drwtkvyghsrrylpflhyfdpdsqiekdhdsktgvdpdsaqrlirelyslldflrndfshnrldgttf<br>ehlevspdissfitgtyslacgraqsrfadffkpddfvlaknrkeqlisvadgkecltvsglafficlfl<br>dreqasgmlsrirgfkrtdenwarahvetfcdlcirhphdrlessntkeallldmlnelnrcprilyd<br>mlpeeeraqflpaldensmnnlsenslneesrllwdgssdwaealtkrirhqdrfpylmlrfieem<br>dllkgirfrvdlgeieldsyskkvgrngeydrtitdhalafgklsdfqneeevsrmisgeasypvrfs<br>lfapryaiydnkigychtsdpvypksktgekralsnprsmgfisvhdlrklllmellcegsfsrmqs<br>dflrkanrildetaegklqfsalfpemrhrfippqnpkskdrrekaettlekykqeikgrkdklnsql<br>lsafdmdqrqlpsrlldewmnirpashsvklrtyvkqlnedcrlrlqkfrkdgdgkaraiplvge<br>matflsqdivrmiiseetkklitsayynemqrslaqyageenrhqfraivaelrlldpssghpflsat<br>metahrytedfykcylekkrewlaktfyrpeqdentkrrisvffvpdgearkllplirrrmkeqnd<br>lqdwirnkqahpidlpshlfdskimellkykdgkkkwneafkdwwstkypdgmqpfyglrre<br>lnihgksysyipsdgkkfadcythlmektvqdkkrelrtagkpvppdlaadikrsfhravneref<br>mlrlvqeddrlmlmainkmmtdreedilpglknidsildeenqfslavhakvlekegeggdnsl<br>slvpatieikskrkdwskyiryrydrrvpglmshfpehkatldevktllgeydrcrikifdwafale<br>gaimsdrdlkpylhesssregksgehstivkmlvekkgcltpdesqylililirnkaahnqfpcaae<br>mpliyrdvsakvgsiegssakdlpegsslvdslwkkyemiirkilpildpenrffgkllnnmsqpi<br>ndl |
| HMPREF1988_<br>01768<br>[*Porphyromonas*<br>*gingivalis*<br>F0185] | ERJ81987<br>(SEQ ID<br>NO: 66) | mntvpasenkgqsrtveddpqyfglylnlarenlieveshvrikfgkkklneeslkqsllcdhllsv<br>drwtkvyghsrrylpflhyfdpdsqiekdhdsktgvdpdsaqrlirelyslldflrndfshnrldgttf<br>ehlevspdissfitgtyslacgraqsrfadffkpddfvlaknrkeqlisvadgkecltvsglafficlfl<br>dreqasgmlsrirgfkrtdenwarahvetfcdlcirhphdrlessntkealllldmlnelnrcprilyd<br>mlpeeeraqflpaldensmnnlsenslneesrllwdgssdwaealtkrirhqdrfpylmlrfieem<br>dllkgirfrvdlgeieldsyskkvgrngeydrtitdhalafgklsdfqneeevsrmisgeasypvrfs<br>lfapryaiydnkigychtsdpvypksktgekralsnpqsmgfisvhdlrklllmellcegsfsrmq<br>sgflrkanrildetaegklqfsalfpemrhrfippqnpkskdrrekaettlekykqeikgrkdklnsq<br>llsafdmnqrqlpsrlldewmnirpashsvklrtyvkqlnedcrlrlrkfrkdgdgkaraiplvge<br>matflsqdivrmiiseetkklitsayynemqrslaqyageenrrqfraivaelhlldpssghpflsat<br>metahrytedfykcylekkrewlaktfyrpeqdentkrrisvffvpdgearkllplirrrmkeqnd<br>lqdwirnkqahpidlpshlfdskimellkykdgkkkwneafkdwwstkypdgmqpfyglrre<br>lnihgksysyipsdgkkfadcythlmektvqdkkrelrtagkpvppdlaadikrsfhravneref<br>mlrlvqeddrlmlmainkmmtdreedilpglknidsildeenqfslavhakvlekegeggdnsl<br>slvpatieikskrkdwskyiryrydrrvpglmshfpehkatldevktllgeydrcrikifdwafale<br>gaimsdrdlkpylhesssregksgehstivkmlvekkgcltpdesqylililirnkaahnqfpcaae<br>mpliyrdvsakvgsiegssakdlpegsslvdslwkkyemiirkilpildhenrffgkllnnmsqpi<br>ndl |
| HMPREF1<br>990_01800<br>[*Porphyromonas*<br>*gingivalis*<br>W4087] | ERJ87335<br>(SEQ ID<br>NO: 67) | mntvpasenkgqsrtveddpqyfglylnlarenlieveshvrikfgkkklneeslkqsllcdhllsv<br>drwtkvyghsrrylpflhyfdpdsqiekdhdsktgvdpdsaqrlirelyslldflrndfshnrldgttf<br>ehlevspdissfitgtyslacgraqsrfadffkpddfvlaknrkeqlisvadgkecltvsglafficlfl<br>dreqasgmlsrirgfkrtdenwarahvetfcdlcirhphdrlessntkeallldmlnelnrcprilyd<br>mlpeeeraqflpaldensmnnlsenslneesrllwdgssdwaealtkrirhqdrfpylmlrfieem<br>dllkgirfrvdlgeieldsyskkvgrngeydrtitdhalafgklsdfqneeevsrmisgeasypvrfs<br>lfapryaiydnkigychtsdpvypksktgekralsnprsmgfisvhdlrklllmellcegsfsrmqs<br>dflrkanrildetaegklqfsalfpemrhrfippqnpkskdrrekaettlekykqeikgrkdklnsql<br>lsafdmdqrqlpsrlldewmnirpashsvklrtyvkqlnedcrlrlqkfrkdgdgkaraiplvge<br>matflsqdivrmiiseetkklitsayynemqrslaqyageenrhqfraivaelrlldpssghpflsat<br>metahrytedfykcylekkrewlaktfyrpeqdentkrrisvffvpdgearkllplirrrmkeqnd<br>lqdwirnkqahpidlpshlfdskvmellkykdgkkkwneafkdwwstkypdgmqpfyglrr<br>elnihgksysyipsdgkkfadcythlmektvrdkkrelrtagkpvppdlaayikrsfhravneref<br>mlrlvqeddrlmlmainkimtdreedilpglknidsildkenqfslavhakvlekegeggdnslsl<br>vpatieikskrkdwskyiryrydrrvpglmshfpehkatldevktllgeydrcrikifdwafalega<br>imsdrdlkpylhesssregksgehstivkmlvekkgcltpdesqylililirnkaahnqfpcaaeipli<br>yrdvsakvgsiegssakdlpegsslvdslwkkyemiirkilpildpenrffgkllnnmsqpindl |
| M573_117042<br>[*Prevotella*<br>*intermedia*<br>ZT] | KJJ86756<br>(SEQ ID<br>NO: 68) | mkmeddkkttestnmldnkhfwaaflnlarhnvyitvnhinkvlelknkkdqdiiidndqdilai<br>kthwekvngdlnkterlrelmtkhfpfletaiytknkedkeevkqekqaeaqsleslkdclflflek<br>lqearnyyshykysestkepmleegllekmynifddniqlvikdyqhnkdinpdedflchldrkg<br>qfkysfadnegnitesgllfffvslflekkdaiwmqqkltgfkdnresskkkmthevfcrrrmllpklr<br>lestqtqdwilldmlnelircpkslyerlqgeyrkkfnvpfdsadedydaeqepfkntivrhqdrfp<br>yfalryfdyneiftnlrfqidlgtyhfsiykkligggkedrhlthklygferiqefakqnrpdewkal<br>vkdldtyetsneryisettphyhlenqkigirfrngnkeiwpslktngennekskykldpkyqaea<br>flsvhellpmmfyyllllkkeepnndkknasivegfikreirdmyklydafangeinnigdlekyc<br>edkgipkrhlpkqmvailydepkdmvkeakrkqkemvkdtkkllatlekqteeiedggrniirl<br>lksgeiarwlynedmmrfqpvqkdnegnpinnskansteyqmlqrslalynkeekptryfrqvnl<br>inssnphpflkwtkweecnnilsfyrnyltkkieflnklkpedweknqyflklkepktnretivqg<br>wkngfnlprgiftepirewflcrhqndskeyekvealkrvglvtkvipflfffkeeyfkedaqkeinnc<br>vqpfysfpynvgnihkpdekdflpseerkklwgdkkdkfkgykakvkskkltdkekeeyrsyl<br>efqswnkferelvrlyrnqdivtwllctelidkmkveglnveelqklrlkdidtdtakqeknnilnri<br>mpmqlpvtvyeiddshnivkdrplhtvyieetktkllkqgnfkalvkdrringlfsfvdtsskaelk<br>dkpisksvveyelgeyqnarietikdmillektllikkyekltptnfsdmlngwlegkdesdkarfq<br>ndvkllvavrnafshnqypmrnriafaninpfslssadiseekkldianqlkdkthkiikkiieiek<br>pietke |

TABLE 6-continued

| A2033_10205 [Bacteroidetes bacterium GWA2_31_9] | OFX18020.1 (SEQ ID NO: 69) | menqtqkgkgiyyyytknedkhyfgsflnlannnieqiieefrirlslkdeknikeiinnyftdkks ytdwerginilkeylpvidyldlaitdkefekidlkqketakrkyfrtnfslliditiidlrnfythyfhk pisinpdvakfldknllnycldikkqkmktdktkqalkdgldkelkklielkkaelkekkiktwni tenvegavyndafnhmvyknnagvtilkdyhksilpddkidselklnfsisglvfllsmflskkei eqfksnlegfkgkvigengeyeiskfnnslkymathwifsyltflcglkqrvkntfdketllmqmi delnkvphevyqtlskeqqnefledineyvqdneenkksmensivvhpvirkryddkfnyfair fldefanfptlkffvtagnfvhdkrekqiqgsmltsdrmikekinvfgklteiakyksdyfsnentl etsewelfpnpsylliqnnipvhidlihnteeakqcqiaidrikettnpakkrntrkskeeiikiiyqk nkniykygdptallssnelpaliyellvnkksgkeleniivekivnqyktiagfekgqnlsnslitkkl kksepnedkinaekiillainrereleitenklniiknnraefrtgakrkhifyskelgqeatwiaydlkrf mpeasrkewkgfhhselqkflafydrnkndakallnmfwnfdndqligndlnsafrefhfdkfy ekylikrdeilegfksfisnflcdepkllkkgikdiyrvfdkryyiikstnaqkeqllskpiclprgifd nkptyiegvkvesnsalfadwyqytysdkhefqsfydmprdykeqfekfelnniksiqnkknln ksdkfiyfrykqdlkikqiksqdlfiklmvdelfnvvfknnielnlkklyqtsderfknqliadvqk nrekgdtsdnkmnenfiwnmtiplslcngqieepkvlkldigkfrkletddkviqlleydkskv wkkleiedelenmpnsyerirrekllkgiqefehfllekekfdginhpkhfeqdlnpnfktyving vlrknsklnyteidklldlehisikdietsakeihlayflihvrnkfghnqlpkleafelmkkyykn neetyaeyfhkvssqivnefknslekhs |
| SAMN05421542_0666 [Chryseo-bacterium jejuense] | SDI27289.1 (SEQ ID NO: 70) | mektqtglgiyydhtklqdkyffggfnlaqnnidnvikafiikffperkdkdiniaqfldicfkdn dadsdfqkhknkflrihfpvigfltsdndkagfkkkfalllktiselrnfythyyhksiefpselfelldd ifvkttseikklkkkddktqqllknknleeydiryqqqierlkelkaqgkrvsltdetairngvfnaaf nhliyrdgenvkpsrlyqssysepdpaengislsqnsilfllsmflerketedlksrvkgflcakiikq geeqisglkfmathwvfsylcfkgikqklstefheetlliqiidelskvpdevysafdsktkekfled ineymkegnadlsledskvihpvirkryenkfnyfairfldeylsstslkfqvhvgnyvhdrrvkh ingtgfqterivkdrikvfgrlsnisnlkadyikeqlelpndsngweifpnpsyifidnnvpihvlad eatkkgielfkdkrrkeqpeelqkrkgkiskynivsmiykeakgkdklrideplallslneipally qilekgatpkdieliiknkltefekiknydpetpapasqiskrlrnnttakgqealnaeklsllieriee ntetklssieekrlkakkeqrrntpqrsifsnsdlgriaawladdikrfmpaeqrknwkgyqhsql qqslayfekrpqeafllllkegwdtsdgssywnnwymnsflennhfekfyknylmkrvkyfsel agnikqhthntkflrkfikqqmpadlfpkrhyilkdleteknkvlskplvfsrglfdnnptfikgvk vtenpelfaewysygykteehvfqhfygwerdyneelldselqkgnsfaknsiyynresqldliklk qdlkikkikiqdlflkriaeklfenvfnypttlsldefyltqeeraekerialaqslreegdnspniikd dfiwsktiafrskqiyepaiklkdigkfnrfvlddeeskaskllsydknkiwnkeqlerelsigens yevirreklfkeignielqilsnwswdginhprefemedqkntrhpnfkmylvngilrkninlyk ededfwleslkendflalpsevletksemvqllflvilirnqfahnqlpeiqfynfirknypeiqnnt vaelylnliklavqklkdns |
| SAMN05444360_11366 [Chryseo-bacterium carnipullorum] | SHM52812.1 (SEQ ID NO: 71) | mntrvtgmgvsydhtkkedkhffggflnlaqdnitavikafcikfdknpmssvqfaescftdkds dtdfqnkvryvrthlpvigylnyggdrntfrqklstllkavdslrnfythyyhsplalstelfelldtvf asvavevkqhkmkddktrqllskslaeeldirykqqlerlkelkeqgknidlrdeagirngvinaa fnhliykegeiakptlsyssfyygadsaengitisqsgllfllsmflgkkeiedlksrirgfkakivrdg eenisglkfmathwifsylsflcgmkqrlstdfheetlliqiidelskvpdevyhdfdtatrekfvedi neyiregnedfslgdstiihpvirkryenkfnyfavrfldefikfpslrfqvhlgnfvhdrrikdihgt gfqtervvkdrikvfgklseissslkteyiekeldldsdtgweifpnpsyvfidnnipiyistnktfkng ssefiklrrkekpeemkmrgedkkekrdiasmignagslnsktplamlslnempallyeilvkkt tpeeieliikekldshfeniknydpekplpasqiskrlrnnttdkgkkvinpeklihlinkeidateak fallaknrelkekefrgkplrqtifsnmelgreatwladdikrfmpdilrknwkgyqhnqlqqsla ffnsrpkeaftilqdgwdfadgssfwngwiinsfvknrsfeyfyeayfegrkeyfsslaenikqhts nhrnlrrfidqqmpkglfenrhyllenleteknkilskplvfprglfdtkptfikgikvdeqpelfae wyqygystehvfqnfygwerdyndlleselekdndfsknsihysrtsqleliklkqdlkikkikiq dlflkliaghifenifkypasfsldelyltqeerinkeqealiqsqrkegdhsdniikdnfigsktvtye skqisepnvlkldigkfnrflldkvktllsynedkvwnknldldlelsigensyevirreklfkkiq nfelqtltdwpwngtdhpeefgttdnkgvnhpnfkmyvvngilrkhtdwfkegednwlenlne thfknlsfqeletksksiqtafliimirnqfahnqlpavqffefiqkkypeiqgsttselylnfinlavv ellellek |
| SAMN05421786_1011119 [Chryseo-bacterium ureilyticum] | SIS70481.1 (SEQ ID NO: 72) | metqilgngisydhtkedkhffggflntaqnnidllikayiskfessprklnsvqfpdvcflcknds dadfqhklqfirkhlpviqylkyggnrevlkekifilllqavdslrnfythfyhkpiqlpnelltlldtif geignevrqnkmkddktrhllkknlseeldfryqeqlerlrklksegkkvdlrdteairngvinaaf nhliflcdaedflcptvsyssyyydsdtaengisisqsqsgllfllsmflgrremedlksrvrgfkariikh eeqhvsglkfmathwvfsefcflcgiktrinadyheetlliqlidelskvpdelyrsfdvatrerfiedi neyirdgkedkslieskvihpvirkryeskfnyfairflddefvnfptlrfqvhagnyvhdrriksiegt gfkterlykdrikvfgklstisslkaeylakavnitddtgwellphpsyvfidnnipihltvdpsflai gvkeyqekrklqkpeemknrqggdkmhkpaisskigkskdinpespvallsmneipallyeil vkkaspeeveakirqkltavferirdydpkvplpasqvskrlrnntdtlsynkeklvelankeveqt erklalitknrrecrekvkgkfkrqkvfknaelgteatwlanddikrfmpeeqkknwkgyqhsqlq qslaffesrpgearsllqagwdfsdgssfwngwvmnsfardntfdgyesylngrmkyflrladn iaqqsstnklisnfikqqmpkglfdrrlymledlateknkilskplifprgifddkptfkkgvqvsee peafadwysygydvkhkfqefyawdrdyeellreelekdtaftknsihysresqiellakkqdlk vkkvriqdlylklmaeflfenvfghelalpldqfyltqeerlkqeqeaivqsqrpkgddspnivke nfiwsktipfksgrvfepnvlkldigkfrnlltdekvdillsynnteigkqvieneliigagsyefirr eqlfkeiqqmkrlslrsvrgmgvpirinlk |
| Prevotella buccae | WP_004343581 (SEQ ID NO: 73) | mqkqdklfvdrkknaifafpkyitimenqekpepiyyeltdkhfwaaflnlarhnvyttinhinrr leiaelkddgymmdikgswneqakkldkkvrlrdlimkhfpfleaaayeitnskspnnkeqrek eqsealslnnlknvlfiflekqlvrnyyshykyseespkpifetsllknmykvfdanvrlvkrdy mhhenidmqrdfthlnrkkqvgrtkniidspnfhyhfadkegnmtiaglfffvslfldkkdaiw mqkklkgflcdgrnleqmtnevfcrsrislpklklenvqtkdwmqldmlnelvrcpkslyerlre kdresfkvpfdifsddydaeeepfkntivrhqdrfpyfvlryfdlneifeqlrfqidlgtyhfsiynkr |

TABLE 6-continued

```
              igdedevrhlthhlygfariqdfaqqnqpevwrklvkdldyfeasqepyipktaphyhlenekig
              ikfcsthnnlfpslktektcngrskfnlgtqftaeaflsvhellpmmfyyllltkdysrkesadkvegi
              irkeisniyaiydafangeinsiadltcrlqktnilqghlpkqmisilegrqkdmekeaerkigemi
              ddtqrrldllckqtnqkirigkrnagllksgkiadwlvndmmrfqpvqkdqnnipinnskanste
              yrmlqralalfgsenfrlkayfnqmnlvgndnphpflaetqwehqtnilsfyrnyleaarkkylkgl
              kpqnwkqyqhfliilkvqktnrntivtgwknsfnlprgiftqpirewfekhnnskriydqilsfdry
              gfvakaiplyfaeeykdnvqpfydypfnignklkpqkgqfldkkervelwqknkelflcnypse
              kkktdlayldflswkkferelrliknqdivtwlmflcelfnmatvegikigeihlrdidtntaneesn
              nilnrimpmklpvktyetdnkgnilkerplatfyieetetkvlkqgnfkvlakdrringllsfaettdi
              dleknpitklsvdhelikyqttrisifemtlglekklinkyptlptdsfrnmlerwlqckanrpelkn
              yvnsliavrnafshnqypmydatlfaevkkftlfpsvdtkkielniapqlleivgkaikeieksenk
              n Porphyromonas   WP_       mntvpasenkgqsrtveddpqyfglylnlarenlieveshvrikfgkkklneeslkqsllcdhllsv
gingivalis      005873511 drwtkvyghsrrylpflhyfdpdsqiekdhdsktgvdpdsaqrlirelysllldflrndfshnrldgttf
                (SEQ ID   ehlevspdissfitgtyslacgraqsrfadffkpddfvlaknrkeqlisvadgkecltvsglafficlfl
                NO: 74)   dreqasgmlsrirgfkrtdenwaravhetfcdlcirhphdrlessntkealildmlnelnrcprilyd
                          mlpeeeraqflpaldensmnnlsenslneesrllwdgssdwaealtkrirhqdrfpylmlrfieem
                          dllkgirfrvdlgeieldsykkvgrngeydrtitdhalafgklsdfqneeevsrmisgeasypvrfs
                          lfapryaiydnkigychtsdpvypksktgekralsnpqsmgfisvhnlrklllmellcegsfsrmq
                          sdflrkanrildetaegklqfsalfpemrhrfippqnpkskdrrekaettlekykqeikgrkdklnsq
                          llsafdmnqrqlpsrlldewmnirpashsvklrtyvkqlnedcrlrlrkfrkdgdgkaraiplvge
                          matflsqdivrmiiseetkklitsayynemqrslaqyageenrrqfraivaellilldpssghpflsat
                          metahrytedfykcylekkrewlaktfyrpeqdentkrrisvffvpdgearkllpllirrrmkeqnd
                          lqdwirnkqahpidlpshlfdskimellkvkdgkkkwneafkdwwstkypdgmqpfyglrre
                          lnihgksysyipsdgkkfadcythlmektvqdkkrelrtagkpvppdlaadikrsfhravneref
                          mlrlvqeddrlmlmainkmmtdreedilpglknidsildeenqfslavhakvlekegeggdnsl
                          slvpatieikskrkdwskyiryrydrrvpglmshfpehkatldevkt1llgeydrcrikifdwafale
                          gaimsdrdlkpylhesssregksgehstivkmlvekkgcltpdesqylilirnkaahnqfpcaae
                          mpliyrdvsakvgsiegssakdlpegsslvdslwkkyemiirkilpildpenrffgkllnnmsqpi
                          ndl Porphyromonas   WP_       mtecinekpyngtyytledkhfwaaffnlarhnayitlahidrqlayskaditnded11fflcgqwkn
gingivalis      005874195 ldndlerkarlrslilkhfsflegaaygkklfesqssgnkssskkkeltkkekeelqanalsldnlksilf
                (SEQ ID   dflqklkdfrnyyshyrhpesselplfdgnmlqrlynvfdvsvqrvkrdhehndkvdphrhfnhl
                NO: 75)   vrkgkkdkygnndnpfflchhfvdreekvteagllffvslflekrdaiwmqkkirgfkggteayq
                          qmtnevfcrsrislpklkleslrtddwmlldmlnelvrcpkslydrlreedrarfrvpvdilsdeddt
                          dgteedpfkntivrhqdrfpyfalryfdlkkvftslrfhidlgtyhfaiykknigeqpedrhltrnlyg
                          fgriqdfaeehrpeewkrlvrdldyfetgdkpyitqttphyhiekgkiglrfvpegqllwpspevg
                          atrtgrskyaqdkrftaeaflsvhelmpmmfyyfllrekyseeasaekvqgrikrviedvyavyd
                          afardeintrdeldacladkgirrghlprqmiailsqehkdmeekvrkklqemiadtdhrldmldr
                          qtdrkirigrknaglpksgviadwlvrdmmrfqpvakdtsgkpinnskansteyrmlqralalfg
                          gekerltpyfrqmnitggnnphpflhetrweshtnilsfyrsylkarkaflqsigrsdreennhrflllk
                          epktdrqtivagwksefhlprgifteavrdcliemgydevgsykevgfmakavplyferackdry
                          qpfydypfnvgnslkpkkgrflskekraeewesgkerfrdleawshsaarriedafvgieyaswe
                          nkkkieqllqdlslswetfesklkvkadkiniaklkkeileakehpyhdfkswqkferelrlvknqd
                          iitwmmerdlmeenkvegldtgtlylkdirtdvqeqgslnylnhvkpmrlpvvvyradsrghv
                          hkeeaplatvyieerdtkllkqgnfksfvkdrringlfsfvdtgalameqypisklrveyelakyqta
                          rvcafeqtleleesslltryphlpdesfremleswsdplldkwpdlqrevrlliavrnafshnqypmy
                          detifssirkydpssldaieermglniahrlseevklakemveriiqa Prevotella      WP_       mkeeekgktpvvstynkddkhfwaaflnlarhnvyitvnhinkilgegeinrdgyentlekswn
pallens         006044833 eikdinkkdrlskliikhfpflevttyqrnsadttkqkeekqaeaqsleslkksffvfiyklrdlrnhys
                (SEQ ID   hykhskslerpkfeedlqekmynifdasiqlvkedykhntdiktedfflchldrkgqfkysfadne
                NO: 76)   gnitesgllffvslflekkdaiwvqkkleglccsnesyqkmtnevfcrsrmllpklrlqstqtqdwil
                          ldmlnelircpkslyerlreedrkkfrvpieiadedydaeqepflcnalvrhqdrfpyfalryfdynei
                          ftnlrfqidlgtyhfsiykkqigdykeshhlthklygferiqfeftkqnrpdewrkfvktfnsfetske
                          pyipettphyhlenqkigirfrndndkiwpslktnsekneksykyldksfqaeaflsvhellpmm
                          fyylllktentdndneietkkkenkndkqekhkieeiiienkiteiyalydafangkinsidkleeyc
                          kgkdieighlpkqmiailksehkdmateakrkqeemladvqkslesldnqineeienverknssl
                          ksgeiaswlyndmmrfqpvqkdnegnpinnskansteyqmlqrslalynkeekptryfrqvnl
                          iessnphpflnntewekcnnilsfyrsyleaakknfleslkpedweknqyflmlkepktncetivqg
                          wkngfnlprgiftepirkwfmehrknitvaelkrvglvakviplffseeykdsvqpfynylfnvg
                          ninkpdeknflnceerrellrkkkdefkkmtdkekeeenpsylefqswnkferelrlyrnqdivtwl
                          lcmelfnkkkikelnvekiylknintnttkkekenteekngeekiikeknnilnrimpmrlpikvyg
                          renfsknkkkkirrntfftcvyieekgtkllkqgnfkalerdrrlgglfsfvkthskaesksntiskrsve
                          yelgeyqkarieiikdmlaleetlidkynsldtdnfhnmltgwlklkdepdkasfqndvdlliavr
                          nafshnqypmrnriafaninpfslssantseekglgianqlkdkthktiekiieiekpietke Myroides        WP_       mkdilttdttekqnrfyshkiadkyffggyfnlasnniyevfeevnkrntfgklakrdngnlknyii
odoratimimus    006261414 hvfkdelsisdfekrvcalfasyfpiletvdkksikernrtidltlsqrirqfremlislvtavdqlrnfyth
                (SEQ ID   yhhseivienkvldflnsslvstalhvkdkyltktdktkeflketiaaaeldilleaykkkqiekkntrfk
                NO: 77)   ankredilnaiyneafwsfindkdkdketvvakgadayfeknhhksndpdfalnisekgivylls
                          ffltnkemdslkanitgfkgkvdresgnsikymatqriysfhtyrglkqkirtseegvketllmqmi
                          delskvpnvvyqhlsttqqnsfiedwneseyqddvetddlsrvihpvirkryedrfnyfairfl
                          deffdfptlrfqvhlgdyhvhdrrtkqlgkvesdriikekvtvfarlkdinsakanyfhsleeqdkeel
                          dnkwtlfpnpsydfpkehtlqhqgeqknagkigiyvklrdtqykekaaleearkslnpkersatk
                          askydiitqiieandnvksekplvftgqpiaylsmndihsmlfslltdnaelkktpeeveaklidqi
                          gkqineilskdtdtkilkkykdndlketdtdkitrdlardkeeieklileqkqraddynytsstkfnid
                          ksrkrkhllfnaekgkigvwlandikrfmteefkskwkgyqhtelqklfayydtsksdldlilsdm
```

TABLE 6-continued

| | | |
|---|---|---|
| | | vmvkdypielialvkksrtivdflnkylearlgymenvitrvknsigtpqflctvrkecftflkksnyt vvslkdqverilsmplfiergfmddkptmlegksyqqhkekfadwfvhykensnyqnfydtev yeittedkrekakvtkkikqqqkndvftlmmvnymleevlklssndrlslnelyqtkeerivnkq vakdtgernknyiwnkvvdlqlceglvridkvklkdignfrkyendsrvkefltyqsdivwsayl snevdsnklyvierqldnyesirskellkevqeiecsvynqvankeslkqsgnenfkqyvlqglv pigmdvremlilstdvkfikeeiiqlgqageveqdlysliyirnkfahnqlpikeffdfcennyrsis dneyyaeyymeifrsikekyts |
| *Myroides odoratimimus* | WP_006265509 (SEQ ID NO: 78) | mkdilttdttekqnrfyshkiadkyffggyfnlasnniyevfeevnkrntfgklakrdngnlknyii hvfkdelsisdfekrvaifasyfpiletvdkksikernrtidltlsqrirqfremlislvtavdqlrnfyth yhhseivienkvldflnsslvstalhvkdkylktdktkeflketiaaeldilleaykkkqiekknrfk ankredilnaiyneafwsfindkdkdketvvakgadayfeknhhksndpdfalniseekgivylls ffltnkemdslkanitgfkgkvdresgnsikymatqriysfhtyrglkqkirtseegvketllmqmi delskvpnvvyqhlsttqqnsfiedwneyykdyeddvetddlsrvihpvirkryedrfnyfairfl deffdfptlrfqvhlgdyvhdrrtkqlgkvesdriikekvtvfarlkdinsakasyfhsleeqdkeel dnkwtlfpnpsydfpkehtlqhqgeqknagkigiyvklrdtqykekaaleearkslnpkersatk askydiitqiieandnvksekplvftgqpiaylsmndihsmlfslltdnaelkktpeeveaklidqi gkqineilskdtdtkilkkykdndlketdtdkitrdlardkeeiekllileqkqraddynytsstkfnid ksrkrkhllfnaekgkigvwlandikrfmfkeskskwkgyqhtelqklfayfdtsksdlelilsdm vmvkdypielidlyrksrtivdflnkylearlgyienvitrvknsigtpqfktvrkecfaflkesnytv asldkqierilsmplfiergfmdskptmlegksyqqhkedfadwfvhykensnyqnfydtevy eiittedkreqakvtkkikqqqkndvftlmmvnymleevlklpsndrlslnelyqtkeerivnkqv akdtgernknyiwnkvvdlqlceglvridkvklkdignfrkyendsrvkefltyqsdivwsgyls nevdsnklyvierqldnyesirskellkevqeicivynqvankeslkqsgnenfkqyvlqgllpr gtdvremlilstdvkfkkeeimqlgqvreveqdlysliyirnkfahnqlpikeffdfcennyrpisd neyyaeyymeifrsikekyas |
| *Prevotella* sp. MSX73 | WP_007412163 (SEQ ID NO: 79) | mqkqdklfvdrkknaifafpkyitimenqekpepiyyeltdkhfwaaflnlarhnvyttinhinrr leiaelkddgymmgikgswneqakkldkkvrlrdlimkhfpfleaaayeitnskspnnkeqrek eqsealslnnlknvlfifleklqvlrnyyshykyseeespkpifetsllknmykvfdanvrlvkrdy mhhenidmqrdfthlnrkkqvgrtkniidspnfhyhfadkegnmtiagllffvslfldkkdaiw mqkklkgflcdgrnlreqmtnevfcrsrislpklklenvqtkdwmqldmlnelvrcpkslyerlre kdresfkvpfdifsddydaeeepfkntivrhqdrfpyfvlryfdlneifeqlrfqidlgtyhfsiynkr igdedevrhlthhlygfariqdfapqnqpeewrklvkdldhfetsqepyisktaphyhlenekigi kfcsthnnlfpslkrektcngrskfnlgtqftaeaflsvhellpmmfyyllltkdysrkesadkvegii rkeisniyaiydafanneinsiadltcrlqktnilqghlpkqmisilegrqkdmekeaaerkigemid dtqrrldllckqtnqkirigkrnagllksgkiadwlvsdmmrfqpvqkdtnnapinnskansteyr mlqhalalfgsessrlkayfrqmnlvgnanphpflaetqwehqtnilsfyrnylearkkylkglkp qnwkqyqhlliilkvqktnrntivtgwknsfnlprgiftqpirewfekhnnskriydqilsfdrvgfv akaiplyfaeeykdnvqpfydypfnignklkpqkgqfldkkervelwqknkelfknypseknk tdlayldflswkkferelrliknqdivtwlmflcelflattveglkigeihlrdidtntaneesnnilnri mpmklpvktyetdnkgnilkerplatfyieeetktvlkqgnfkvlakdrringllsfaettdidlekn pitklsvdyelikyqttrisifemtlglekklidkystlptdsfrnmlerwlqckanrpelknyvnsli avrnafshnqypmydatlfaevkkftlfpsvdtkkielniapqlleivgkaikeieksenkn |
| *Porphyromonas gingivalis* | WP_012458414 (SEQ ID NO: 80) | mtegnerpyngtyytledkhfwaaffnlarhnayitlahidrqlayskaditndedilffkgqwkn ldndlerkarlrslilkhfsflegaaygkklfesqsgnksskkkeltkkekeelqanalsldnlksilf dflqklkdfrnyyshyrhpesselplfdgnmlqrlynvfdvsvqrvkrdhehndkvdphrhfnhl vrkgkkdrygnndnpffkhhfvdreekvteagllffvslflekrdaiwmqkkirgfkggtetyqq mtnevfcrsrislpklklesrtddwmlldmlnelvrcpkslydrlreedrarfrvpvdilsdeddtd gteedpfkntivrhqdrfpyfalryfdlkkvftslrfhidlgtyhfaiykknigeqpedrhltrnlygf griqdfaeehrpeewkrlyrdldyfetgdkpyitqttphyhiekgkiglrfvpegqhlwpspevga trtgrskyaqdkrltaeaflsvhelmpmmfyyfllrekysdeasaervqgrikrviedvyavydaf argeeintrdeldacladkgirrghlprqmigilsgehkdmeekvrkklqemivdtdhrldmldrqt drkirigrknaglpksgviadwlvrdmmrfqpvakdtsgkpinnskansteyrmlqralalfgge kerltpyfrqmnitggnnphpflhetrweshtnilsfyrsylkarkaflqsigrsdrvenhrflllkep ktdrqtivagwkgefhlprgifteavrdcliemgldevgsykevgfmakavplyferackdrvqp fydypfnvgnslkpkkgrflskekraeewesgkerfrlaklkkkeileakehpyldfkswqkferel rlyknqdiitwmicrdlmeenkveglldtgtlylkdirtdvqeqgnlnylnrvkpmrlpvvvyrad srghvhkeqaplatvyieerdtkllkqgnfksfvkdrringlfsfvdtgalameqypisklrveyel akyqtarvcafeqtleleeslltryphlpdknfrkmleswsdplldkwpdlhgnvrlliavrnafsh nqypmydeavfssirkydpsspdaieermglniahrlseevkqakemaeriiqa |
| *Paludibacter propionicigenes* | WP_013446107 (SEQ ID NO: 81) | mktsanniyfnginsfkkifdskgaiapiaekscrnfdikaqndynkeqrihyfavghtflcqldte nlfeyvldenlrakrptrfislqqfdkefienikrlisdirninshyihrfdplkidavptniidflkesfe laviqiylkekginylqfsenphadqklvaflhdkflpldekktsmlqnetpqlkeykeyrkyflal skqaaidqllfaeketdyiwnlfdshpvltisagkylsfysclfllsmflykseamiliskikgflcknt teeekskreiftfffskrfnsmdidseeenqlvkfrdlilylnhypvawnkdleldssnpamtdklksk iieleinrsfplyegnerfatfakyqiwgkkhlgksiekeyinasftdeeitaytyetdtcpelkdahk kladlkaakglfgkrkeknesdikktetsirelqhepnpikdkliqrieknlltvsygrnqdrfmdfs arflaeinyfgqdasfkmyhfyatdeqnselekyelpkdkkydslkfhqgklvhfisykehlkr yeswddafviennaiqlklsfdgventvtiqrallyllledalrniqnntaenagkqllqeyyshnka dlsaflqiltqqdsiepqqktefkllprrllnnyspainhlqtphsslplilekallaekrycslvvka kaegnyddfikrnkgkqfklqfirkawnlmyfrnsylqnvqaaghhksfhierdefndfsrymf afeelsqykyylnemfekkgffennefkilfqsgtslenlyekktkqkfeiwlasntaktnkpdnyh |

TABLE 6-continued

| | | |
|---|---|---|
| | | lnnyeqqfsnqlffinlshfinylkstgklqtdangqiiyealnnvqylipeyyytdkpersesksgn<br>klynklkatkledallyemamcylkadkqiadkahhpitklltsdvefnitnkegiqlyhllvpflck<br>idafiglkmhkeqqdkkhptsflanivnylelvkndkdirktyeafstnpvkrtltyddlakidghl<br>isksikftnvtleleryfifkeslivkkgnnidfkyiklrnyynnekkknegirnkafhfgipdsks<br>ydqlirdaevmfianevkpthatkytdlnkqlhtvcdklmetvhndyfskegdgkkkreaagqk<br>yfeniisak |
| Porphyromonas<br>gingivalis | WP_<br>013816155<br>(SEQ ID<br>NO: 82) | mteqnekpyngtyytledkhfwaaffnlarhnayitlahidrqlayskaditnededilfflcgqwkn<br>lndndlerkarlrslilkhfsflegaaygkklfesqssgnkssknkeltkkekeelqanalsldnlksilf<br>dflqklkdfrnyyshyrhpesselplfdgnmlqrlynvfdvsvqrvkrdhehndkvdphrhfnhl<br>vrkgkkdrygnndnpfichhfvdregtvteagliffvslflekrdaiwmqkkirgflcggtetyqq<br>mtnevfcrsrislpklkleslrtddwmlldmlnelvrcpkslydrlreedrarfrvpvdilsdeedtd<br>gaeedpfkntivrhqdrfpyfalryfdlkkvftslrfqidlgtyhfaiykknigeqpedrhltrnlygf<br>griqdfaeehrpeewkrivrdldyfetgdkpyitqttphyhiekgkiglrfvpegqhlwpspevga<br>trtgrskyaqdkrftaeaftsahelmpmmfyyfilrekyseeasaervqgrikrviedvyavydaf<br>ardeintrdeldacladkgirrghlprqmigilsqehkdmeekirkklqemmadtdhrldmldrq<br>tdrkirigrknaglpksgviadwlvrdmmrfqpvakdtsgkpinnskansteyrmlqralalfgg<br>ekerltpyfrqmnitggnnphpflhetrweshtnilsfyrsylkarkaflqsigrsdrvenhrfifike<br>pktdrqtivagwkgefhlprgifteavrdcliemgldevgsykevgfmakavplyferackdwv<br>qpfynypfnvgnslkpkkgrflskekraeewesgkerfrlaklkkeileakehpyldfkswqkfe<br>relrivknqdiitwmicgdlmeenkvegldtgtlylkdirtdvqeqqslnvinrvkpmrlpvvvy<br>radsrghvhkeqaplatvyieerdtkllkqgnfksfvkdrringlfsfvdtgalameqypisklrve<br>yelakyqtarvcafeqtleleeeslltrcphlpdknfrkmleswsdpildkwpdlhrkvriliavrnaf<br>shnqypmydeavfssirkydpsfpdaieermglniahrlseevkqaketveriiqa |
| Flavobacterium<br>columnare | WP_<br>014165541<br>(SEQ ID<br>NO: 83) | mssknesynkqktfnhykqedkyffggfinnaddnlrqvgkefktrinfnhnnnelasvfkdyf<br>nkeksvakrehalnllsnyfpvleriqkhtnhnfeqtreifellldtikklrdyythhyhkpitinpki<br>ydflddtlldvlitikkkkvkndtsrellkeklrpeltqlknqkreelikkgkkllleenlenavfnhclr<br>pfleenktddkqnktvslrkyrkskpneetsititqsgglvflmsfflhrkefqvftsglegfkakvnti<br>keeeislnknnivymithwsysyynfkglkhriktdqgvstleqnntthsltntntkealltqivdyl<br>skvpneiyetlsekqqkefeedineymrenpenedstfssivshkvirkryenkfnyfamrflde<br>yaelptlrfmvnfgdyikdrqkkilesiqfdseriikkeihlfeklslvteykknvylketsnidlsrfp<br>lfpnpsyvmannnipfyidsrsnnldeylnqkkkaqsqnkkrnitfekynkeqskdaiiamlqk<br>eigvkdlqqrstigllscnelpsmlyeivivkdikgaelenkiaqkireqyqsirdftldspqkdnipt<br>tliktintdssvtfenqpidiprlknaiqkeltitqeklnykeheievdnynrnkntykfknqpknk<br>vddkklqrkyvfyrneirqeanwlasdlihfmknkslwkgymhnelqsflaffedkkndciall<br>etvfnlkedciltkglknlflkhgnfidfykeylklkedfintesiftengligllppkilkkelskrflcyi<br>fivfqkrqfiikeleekknnlyadainlsrgifdekptmipfkkpnpdefaswfvasyqynnyqsf<br>yeltpdiverdkkkkyknlrainkvkiqdyylklmvdtlyqdlfnqpldkslsdfyvskaerekik<br>adakayqkrndsslwnkvihlslqnnritanpklkdigkykralqdekiatlltyddrtwtyalqkp<br>ekenendykelhytalnmelqeyekvrskellkqvqelekqileeytdflstqihpadferegnpn<br>fkkylahsileneddldklpekveamreldetitnpiikkaivliiirnkmahnqyppkfiydlanr<br>fvpkkeeeyfatyfnrvfetitkelwenekkkdktqv |
| Psychroflexus<br>torquis | WP_<br>015024765<br>(SEQ ID<br>NO: 84) | mesiiglgslsfnpyktadkhyfgsfinlvennlnavfaefkerisykakdenissliekhfidnmsi<br>vdyekkisilngylpiidflddelennintrvknfkknfiilaeaieklrdyythfyhdpitfednkep<br>llelldevilktildvkkkyltkdtkteilkdslreemdllvirktdelrekkktnpkightdsssqikns<br>ifndafqgllyedkgnnkktqvshraktrinpkdihkqeerdfeiplststglvflmslflskkeiedf<br>ksnikgfkgkvvkdenhnslkymathrvysilaflcglkyriktdtfsketimmqmidelskvpd<br>cvygnisetkqkdfiedwneyflcdneentenlensrvvhpvirkryedkfnyfairflfdefanflcti<br>kfqvfmgyyihdqrtktigttnnittertvkekinvfgklskmdnlkkhffsqlsddentdweffpn<br>psynfltqadnspannipiylelknqqiikekdaikaevnqtqnrnpnkpskrdllnkilktyedfh<br>qgdptailslneipallhlfivkpnnktgqqieniirikiekqfkainhpsknnkgipkslfadtnvry<br>naiklkkdleaeldmlnkkhiafkenqkassnydkllkehqftpknkrpelrkyvfyksekgeea<br>twlandikrfmpkdfktkwkgcqhselqrklafydrhtkqdikellsgcefdhslldinayfqkdn<br>fedffskylenrietlegylkklhdfkneptplkgvflmcfldlkrqnyvtespeiikkrilakpfflpr<br>gvfderptmkkgknplkdknefaewfveylenkdyqkfynaeeyrmrdadfkknavikkqkl<br>kdfytlqmvnyllkevfgkdemnlqlselfqtrqerlklqgiakkqmnketgdssentrnqtyiw<br>nkdvpvsffngkvtidkvklknigkykryerdervktfigyevdekwmmylphnwkdrysv<br>kpinvidlqiqeyeeirshellkeignieqyiydhttdknillqdgnpnfkmyvinglligikqvni<br>pdfivlkqntnfdkidftgiascselekktiiliairnkfahnqlpnkmiydlaneflkieknetyany<br>ylkvlkkmisdla |
| Riemerella<br>anatipestifer | WP_<br>015345620<br>(SEQ ID<br>NO: 85) | mffsfhnaqrvifkhlykafdaslrmvkedykahftvnitrdfahlnrkgknkqdnpdfnryrfe<br>kdgfftesgllffftnlfldkrdaywmlkkvsgfkashkqrekmttevfcrsrillpklrlesrydhnq<br>mlldmlselsrcpkllyeklseenkkhfqveadgfldeieeeqnpfkdtlirhqdrfpyfalrylldln<br>esflcsirfqvdlgtyhyciydkkigdeqekrhltrtllsfgrlqdfteinrpqewkaltkdldyketsn<br>qpfiskttphyhitdnkigfrlgtskelypsleikdganriakypynsgfvahafisvhellplmfyq<br>hltgksedllketvrhiqriykdfeeerintiedlekanqgrlplgafpkqmlgllqnkqpdlsekak<br>ikiekliaetkllshrintklkssppklgkrrrekliktgvladwlvkdfmrfqpvaydaqnqpiksska<br>nstefwfirralalyggeknrlegyfkqtnligntnphpflnkfnwkacrnlvdfyqqylegrekfl<br>eaikhqpwepyqyclllkvpkenrknlvkgweqggislprglfteairetlskdltlskpirkeikk<br>hgrvgfisraitlyfkekyqdklqkfynlsykleakapllkkeehyeywqqnkpqspptesqrlelh<br>tsdrwkdyllykrwqhlekkrlyrnqdimlwlmtleltknhfkelnlnyhqlklenlavnvqea<br>daklnpinqtlpmvlpvkvyppttafgevqyhetpirtvyireeqtkalkmgnflcalvkdrringlfs<br>fikeendtqkhpisqlrlrreleiyqslrvdafketlsleekllnkhaslsslenefrtlleewkkkyaas<br>smvtdkhiafiasvrnafchnqypfyketlhapilllftvaqptteekdglgiaeallkylreyceivk<br>sqi |

TABLE 6-continued

| | | |
|---|---|---|
| Prevotella pleuritidis | WP_ 021584635 (SEQ ID NO: 86) | mendkrleesacytlndkhfwaaflnlarhnvyitvnhinktlelknkknqeiiidndqdilaikth wakvngdlnktdrlrelmikhfpfleaaiysnnkedkeevkeekqakaqsfkslkdclflfleklq earnyyshykysessskepefeeegllekmyntfdasirlykedyqynkdidpekdflchlerkedfn ylftdkdnkgkitknglllffvslflekkdaiwmqqkfrgflcdnrgnkekmthevfcrsrmllpkir lestqtqdwilldmlnelircpkslyerlqgayrekflcvpfdsidedydaeqepfrntivrhqdrfp yfalryfdyneifknlrfqidlgtyhfsiykkliggkkedrhlthklygferiqeftkqnrpdkwqaii kdldtyetsneryisettphyhlenqkigirfrndnndiwpslktngeknekskynldkpyqaeaf lsvhellpmmfyylllkmentdndkednevgtkkkgnknnkqekhkieeiienkikdiyalyd aftngeinsidelaeqregkdieighlpkqlivilknkskdmaekanrkqemikdtkkrlatldk qvkgeiedggrnirllksgeiarwlyndmmrfqpvqkdnegkpinnskansteyqmlqrslaly nkeekptryfrqvnlikssnphpfledtkweecynilsfyrnylkakikflnklkpedwkknqyfl mlkepktnrktivqgwkngfnlprgiftepikewfkrhqndseeykkvealdrvglvakviplff keeyfkedaqkeinncvqpfysfpynvgnihkpeeknflhceerrklwdkkkdkfkgykake kskkmtdkekeehrsylefqswnkferelrlryrnqdiltwllctklidklkidelnieelqklrlkdid tdtakkeknnilnrvmpmrlpvtvyeidksfnivkdkplhtvyieetgtkllkqgnfkalvkdrrl nglfsfvktsseaeskskpisklrveyelgayqkaridiikdmlalektlidndenlptnkfsdmlks wlkgkgeankarlqndvgllvavrnafshnqypmynsevfkgmkllslssdipekeglgiakql kdkiketieriieiekeirn |
| Porphyromonas gingivalis | WP_ 021663197 (SEQ ID NO: 87) | mntvpasenkgqsrtveddpqyfglylnlarenlieveshvrikfgkkklneeslkqsllcdhllsv drwtkvyghsrrylpflhyfdpdsqiekdhdsktgvdpdsaqrlirelyslldflrndfshnrldgttf ehlevspdissfitgtyslacgraqsrfadffkpddfvlaknrkeqlisvadgkecltvsglafficlfl dreqasgmlsrirgfkrtdenwaravhetfcdlcirhphdrlessntkeallldmlnelnrcprilyd mlpeeeraqflpaldensmnnlsenslneesrllwdgssdwaealtkrirhqdrfpylmlrfieem dllkgirfrvdlgeieldsyskkvgrngeydrtitdhalafgklsdfqneeevsrmisgeasypvrfs lfapryaiydnkigychtsdpvypksktgekralsnprsmgfisvhdlrklllmellcegsfsrmqs dflrkanrildetaegklqfsalfpemrhrfippqnpkskdrrekaettlekykqeikgrkdklnsql lsafdmdqrqlpsrlldewmnirpashsvklrtyvkqlnedcrlrlqkfrkdgdgkaraiplvge matflsqdivrmiiseetkklitsayynemqrslaqyageenrhqfraivaelrlldpssghpflsat metahrytedfykcylekkrewlaktfyrpeqdentkrrisvffvpdgearkllplliirrmkeqnd lqdwirnkqahpidlpshlfdskimellkykdgkkkwneafkdwwstkypdgmqpfyglrre lnihgksysyipsdgkkfadcythlmektvqdkkrelrtagkpvppdlaadikrsfhravneref mlrlvqeddrlmlmainkmmtdreedilpglknidsildeenqfslavhakvlekegeggdnsl slvpatieikskrkdwskyiryrydrrvpglmshfpehkatldevktllgeydrcrikifdwafale gaimsdrdlkpylhesssregksgehstivkmlvekkgcltpdesqyliliirnkaahnqfpcaae mpliyrdvsakvgsiegssakdlpegsslvdslwkkyemiirkilpildpenrffgkllnnmsqpi ndl |
| Porphyromonas gingivalis | WP_ 021665475 (SEQ ID NO: 88) | mntvpasenkgqsrtveddpqyfglylnlarenlieveshvrikfgkkklneeslkqsllcdhllsv drwtkvyghsrrylpflhyfdpdsqiekdhdsktgvdpdsaqrlirelyslldflrndfshnrldgttf ehlevspdissfitgtyslacgraqsrfadffkpddfvlaknrkeqlisvadgkecltvsglafficlfl dreqasgmlsrirgfkrtnenwaravhetfcdlcirhphdrlessntkeallldmlnelnrcprilyd mlpeeeraqflpaldensmnnlsenslneesrllwdgssdwaealtkrirhqdrfpylmlrfieem dllkgirfrvdlgeieldsyskkvgrngeydrtitdhalafgklsdfqneeevsrmisgeasypvrfs lfapryaiydnkigychtsdpvypksktgekralsnpqsmgfisvhdlrklllmellcegsfsrmq sgflrkanrildetaegklqfsalfpemrhrfippqnpkskdrrekaettlekykqeikgrkdklnsq llsafdmnqrqlpsrlldewmnirpashsvklrtyvkqlnedcrlrlrkfrkdgdgkaraiplvge matflsqdivrmiiseetkklitsayynemqrslaqyageenrrqfraivaelhlldpssghpflsat metahrytedfykcylekkrewlaktfyrpeqdentkrrisvffvpdgearkllpllirrrmkeqnd lqdwirnkqahpidlpshlfdskimellkykdgkkkwneafkdwwstkypdgmqpfyglrre lnihgksysyipsdgkkfadcythlmektvqdkkrelrtagkpvppdlaadikrsfhravneref mlrlvqeddrlmlmainkmmtdreedilpglknidsildkenqfslavhakvlekegeggdnsl slvpatieikskrkdwskyiryrydrrvpglmshfpehkatldevktllgeydrcrikifdwafale gaimsdrdlkpylhesssregksgehstivkmlvekkgcltpdesqyliliirnkaahnqfpcaae mpliyrdvsakvgsiegssakdlpegsslvdslwkkyemiirkilpildhenrffgkllnnmsqpi ndl |
| Porphyromonas gingivalis | WP_ 021677657 (SEQ ID NO: 89) | mntvpasenkgqsrtveddpqyfglylnlarenlieveshvrikfgkkklneeslkqsllcdhllsv drwtkvyghsrrylpflhyfdpdsqiekdhdsktgvdpdsaqrlirelyslldflrndfshnrldgttf ehlevspdissfitgtyslacgraqsrfadffkpddfvlaknrkeqlisvadgkecltvsglafficlfl dreqasgmlsrirgfkrtdenwaravhetfcdlcirhphdrlessntkeallldmlnelnrcprilyd mlpeeeraqflpaldensmnnlsenslneesrllwdgssdwaealtkrirhqdrfpylmlrfieem dllkgirfrvdlgeieldsyskkvgrngeydrtitdhalafgklsdfqneeevsrmisgeasypvrfs lfapryaiydnkigychtsdpvypksktgekralsnpqsmgfisvhdlrklllmellcegsfsrmq sgflrkanrildetaegklqfsalfpemrhrfippqnpkskdrrekaettlekykqeikgrkdklnsq llsafdmnqrqlpsrlldewmnirpashsvklrtyvkqlnedcrlrlrkfrkdgdgkaraiplvge matflsqdivrmiiseetkklitsayynemqrslaqyageenrrqfraivaelhlldpssghpflsat metahrytedfykcylekkrewlaktfyrpeqdentkrrisvffvpdgearkllpllirrrmkeqnd lqdwirnkqahpidlpshlfdskimellkykdgkkkwneafkdwwstkypdgmqpfyglrre lnihgksysyipsdgkkfadcythlmektvqdkkrelrtagkpvppdlaadikrsfhravneref mlrlvqeddrlmlmainkmmtdreedilpglknidsildeenqfslavhakvlekegeggdnsl slvpatieikskrkdwskyiryrydrrvpglmshfpehkatldevktllgeydrcrikifdwafale gaimsdrdlkpylhesssregksgehstivkmlvekkgcltpdesqyliliirnkaahnqfpcaae mpliyrdvsakvgsiegssakdlpegsslvdslwkkyemiirkilpildhenrffgkllnnmsqpi ndl |

TABLE 6-continued

| | | |
|---|---|---|
| Porphyromonas gingivalis | WP_<br>021680012<br>(SEQ ID<br>NO: 90) | mntvpasenkgqsrtveddpqyfglylnlarenlieveshvrikfgkkklneeslkqsllcdhllsv<br>drwtkvyghsrrylpflhyfdpdsqiekdhdsktgvdpdsaqrrlirelyslldflrndfshnrldgttf<br>ehlevspdissfitgtyslacgraqsrfadffkpddfvlaknrkeqlisvadgkecltvsglafficlfl<br>dreqasgmlsrirgfkrtdenwaravhetfcdlcirhphdrlessntkeallldmlnelnrcprilyd<br>mlpeeeraqflpaldensmnnlsenslneesrllwdgssdwaealtkrirhqdrfpylmlrfieem<br>dllkgirfrvdlgeieldsyskkvgrngeydrtitdhalafgklsdfqneeevsrmisgeasypvrfs<br>lfapryaiydnkigychtsdpvypksktgekralsnprsmgfisvhdlrklllmellcegsfsrmqs<br>dflrkanrildetaegklqfsalfpemrhrfippqnpkskdrrekaettlekykqeikgrkdklnsql<br>lsafdmdqrqlpsrlldewmnirpashsvklrtyvkqlnedcrlrlqkfrkdgdgkaraiplvge<br>matflsqdivrmiiseetkklitsayynemqrslaqyageenrhqfraivaelrlldpssghpflsat<br>metahrytedfykcylekkrewlaktfyrpeqdentkrrisvffvpdgearkllpllirrrmkeqnd<br>lqdwirnkqahpidlpshlfdskvmellkykdgkkkwneafkdwwstkypdgmqpfyglrr<br>elnihgksysyipsdgkkfadcythlmektvrdkkrelrtagkpvppdlaayikrsfhravneref<br>mlrlvqeddrlmlmainkimtdreedilpglknidsildenqfslavhakvlekegeggdnslsl<br>vpatieikskrkdwskyiryrydrrypglmshfpehkatldevktllgeydrcrikifdwafalega<br>imsdrdlkpylhesssregksgehstivkmlvekkgcltpdesqyylilirnkaahnqfpcaaeipli<br>yrdvsakvgsiegssakdlpegsslvdslwkkyemiirkilpildpenrffgkllnnmsqpindl |
| Porphyromonas gingivalis | WP_<br>023846767<br>(SEQ ID<br>NO: 91) | mntvpasenkgqsrtveddpqyfglylnlarenlieveshvrikfgkkklneeslkqsllcdhllsv<br>drwtkvyghsrrylpflhyfdpdsqiekdhdsktgvdpdsaqrrlirelyslldflrndfshnrldgttf<br>ehlevspdissfitgtyslacgraqsrfadffkpddfvlaknrkeqlisvadgkecltvsglafficlfl<br>dreqasgmlsrirgfkrtdenwaravhetfcdlcirhphdrlessntkeallldmlnelnrcprilyd<br>mlpeeeraqflpaldensmnnlsenslneesrllwdgssdwaealtkrirhqdrfpylmlrfieem<br>dllkgirfrvdlgeieldsyskkvgrngeydrtitdhalafgklsdfqneeevsrmisgeasypvrfs<br>lfapryaiydnkigychtsdpvypksktgekralsnprsmgfisvhdlrklllmellcegsfsrmqs<br>dflrkanrildetaegklqfsalfpemrhrfippqnpkskdrrekaettlekykqeikgrkdklnsql<br>lsafdmnqrqlpsrlldewmnirpashsvklrtyvkqlnedcrlrlrkfrkdgdgkaraiplvgem<br>atflsqdivrmiiseetkklitsayynemqrslaqyageenrrqfraivaelhlldpssghpflsatm<br>etahrytedfykcylekkrewlaktfyrpeqdentkrrisvffvpdgearkllpllirrrmkeqndlq<br>dwirnkqahpidlpshlfdskimellkykdgkkkwneafkdwwstkypdgmqpfyglrrreln<br>ihgksysyipsdgkkfadcythlmektvqdkkrelrtagkpvppdlaadikrsfhravnerefml<br>rlvqeddrlmlmainkmmtdreedilpglknidsildeenqfslavhakvlekegeggdnslsly<br>patieikskrkdwskyiryrydrrypglmshfpehkatldevktllgeydrcrikifdwafalegai<br>msdrdlkpylhesssregksgehstivkmlvekkgcltpdesqyylilirnkaahnqfpcaaempl<br>iyrdvsakvgsiegssakdlpegsslvdslwkkyemiirkilpildpenrffgkllnnmsqpindl |
| Prevotella falsenii | WP_<br>036884929<br>(SEQ ID<br>NO: 92) | mkndnnstkstdytlgdkhfwaaflnlarhnvyitvnhinkvlelknkkdqeiiidndqdilaiktl<br>wgkvdtdinkkdrlrelimkhfpfleaatyqqsstnntkqkeeeqakaqsfeslkdclflfleklre<br>arnyyshykhsksleepkleekllenmynifdtnvqlvikdyehnkdinpeedflchlgraegefn<br>yyftrnkkgnitesgllffvslflekkdaiwaqtkikgflcdnrenkqkmthevfcrsrmllpklrles<br>tqtqdwilldmlnelircpkslykrlqgekrekfrvpfdpadedydaeqepflcntivrhqdrfpyf<br>alryfdyneiftnlrfqidlgtyhfsiykkqigdkkedrhlthklygferiqefakenrpdewkalvk<br>dldtfeesnepyisettphyhlenqkigirnknkkkkktiwpsletkttvnerskynlgksfkaeaft<br>svhellpmmfyylllnkeepnngkinaskvegiiekkirdiyklygafaneeinneeelkeyceg<br>kdiairhlpkqmiailkneykdmakkaedkgkkmikdtkkrlaaldkqvkgevedggrnikpl<br>ksgriaswlyndmmrfqpvqrdrdgypinnskansteyqllqrtialfgsererlapyfrqmnlig<br>kdnphpflkdtkwkehnnilsfyrsyleakknflgslkpedwkknqyflklkepktnretivqg<br>wkngfnlprgifttepirewfirhqneseeykkvkdfdriglvakviplifkedyqkeiedyvqpfy<br>gypfnvgnihnsqegifinkkereelwkgnktkflcdyktkeknkektnkdkfkkktdeekeefr<br>syldfqswkkferelrlvrnqdivtwilcmelidklkidelnieelqklrlkdidtdtakkeknnilnr<br>impmelpvtvyetddsnniikdkplhtiyikeaetkllkqgnflcalvkdrringlfsfvetsseaelk<br>skpisksklveyelgeyqrarveiikdmirleetligndeklptnkfrqmldkwlehkketddtdlkn<br>dvklltevrnafshnqypmrdriafanikpfslssantsneeglgiakklkdktketidriieieeqta<br>tkr |
| Prevotella pleuritidis | WP_<br>036931485<br>(SEQ ID<br>NO: 93) | mendkrleestcytlndkhfwaaftnlarhnvyitinhinklleirqidndekvldikalwqkvdk<br>dinqkarlrelmikhfpfleaaiysnnkedkeevkeeqkakaqsfkslkdclflfleklqearnyys<br>hykssesskepefeegllekmyntfgvsirlykedyqynkdidpekdfichlerkedfnylftdkd<br>nkgkitkngliffvslflekkdaiwmqqklrgfkdnrgnkekmthevfcrsrmllpkirlestqtq<br>dwilldmlnelircpkslyerlqgayrekfkvpfdsidedydaeqepfrntivrhqdrfpyfalryf<br>dyneifknlrfqidlgtyhfsiykkligdnkedrhlthklygferiqefakqkrpnewqalvkdldi<br>yetsneqyisettphyhlenqkigirfknkkdkiwpsletngkeneksknlldksfqaeaftsihel<br>lpmmfydilllkkeepnndeknasivegfikkeikrmyaiydafaneeinskegleeycknkgfq<br>erhlpkqmiailtnksknmaekakrkqkemikdtkkrlatldkqvkgeiedggrnirllksgeiar<br>wlyndmmrfqsvqkdkegkpinnskansteyqmlqrslalynkeqkptpyfiqvnlikssnph<br>pfleetkweecnnilsfyrsyleakknflesikpedwkknqyflmlkepktnrktivqgwkngfn<br>lprgifttepikewfkrhqndseeykkvealdrvglvakviplfficeeyficedaqkeinncvqpfys<br>fpynvgnihkpeeknflhceerrklwdkkkdkfkgykakekskkmtdkekeehrsylefqsw<br>nkferelrivrnqdivtwilctelidklkidelnieelqklrlkdidtdtakkeknnilnrimpmqlpv<br>tvyeidksfnivkdkplhtiyieetgtkllkqgnfkalvkdrringlfsfvktsseaeskskpisklry<br>eyelgayqkaridiikdmlalektiidndenlptnkfsdmlkswlkgkgeankarlqndvdllvai<br>rnafshnqypmynsevfkgmkllslssdipekeglgiakqlkdkiketieriieieekeirn |
| [Porphyromonas gingivalis | WP_<br>039417390<br>(SEQ ID<br>NO: 94) | mtegnerpyngtyytiedkhfwaaffnlarhnayitiahidrqlayskaditnededilfflcgqwkn<br>ldndlerkarlrslilkhfsflegaaygkklfesqssgnksskkkeltkkekeelqanalsldnlksilf<br>dflqklkdfrnyyshyrhpesselplfdgnmlqrlynvfdvsvqrvkrdhehndkvdphrhfnhl<br>vrkgkkdrygnndnpffichhfvdregtvteagliffvslflekrdaiwmqkkirgflcggteayqq<br>mtnevfcrsrislpklkleslrtddwmildmlnelvrcpkslydrlreedrarfrvpidilsdeddtd<br>gteedpfkntivrhqdrfpyfalryfdlkkvftslrfhidlgtyhfaiykknigeqpedrhltrnlygf |

TABLE 6-continued

| | | |
|---|---|---|
| | | griqdfaeehrpeewkrivrdldyfetgdkpyitqttphyhiekgkiglrfvpegqhlwpspevga
trtgrskyaqdkrltaeaflsvhelmpmmfyyfilrekyseevsaekvqgrikrviedvyavydaf
argeidtldrldacladkgirrghlprqmiailsqehkdmeekvrkklqemiadtdhrldmldrqt
drkirigrknaglpksgviadwlvrdmmrfqpvakdtsgkpinnskansteyrmlqralalfgge
kerltpyfrqmnitsgnnphpflhetrweshtnilsfyrsylkarkafiqsigrsdreenhrifilkep
ktdrqtivagwksefhlprgifteavrdcliemgydevgsykevgfmakavplyferackdrvq
pfydypfnvgnslkpkkgrflskekraeewesgkerfrlaklkkeileakehpyldfkswqkfer
elrlyknqdiitwmmcrdlmeenkvegldtgtlylkdirtdvheqgslnylnrvkpmrlpvvvy
radsrghvhkeqaplatvyieerdtkllkqgnflcsfvkdrringlfsfvdtgalameqypisklrve
yelakyqtarvcafeqtleleesslltryphlpdknfrkmleswsdplldkwpdlhrkvrlliavrnaf
shnqypmydeavfssirkydpsspdaieermglniahrlseevkqakemaeriiqv |
| Porphyromonas gulae | WP_039418912
(SEQ ID NO: 95) | mteqserpyngtyytledkhfwaaflnlarhnayitlthidrqlayskaditndqdvlsflcalwknl
dndlerksrlrslilkhfsflegaaygkklfeskssgnkssknkeltkkekeelqanalsldnlksilfd
flqklkdfrnyyshyrhsgsselplfdgnmlqrlynvfdvsvqrvkrdhehndkvdphrhfnhlv
rkgkkdryghndnpsflchhfvdsegmvteagllffvslflekrdaiwmqkkirgfkggtetyqq
mtnevfcrsrislpklklesslrmddwmlldmlnelvrcpkplydrlrekdrdracfrvpvdilpdedd
tdgggedpfkntivrhqdrfpyfalryfdlkkvftslrfhidlgtyhfaiykkmigeqpedrhltrnl
ygfgriqdfaeehrpeewkrlyrdldyfetgdkpyisqtsphyhiekgkiglrfmpegqhlwpsp
evgttrtgrskyaqdkrltaeaflsvhelmpmmfyyfllrekyseevsaekvqgrikrviedvyai
ydafardeintlkeldacladkgirrghlpkqmiailsgehknmeekvrkklqemiadtdhrldm
ldrqtdrkirigrknaglpksgviadwlvrdmmrfqpvakdasgkpinnskansteyrmlqrala
lfggekerltpyfrqmnitggnnphpflhdtrweshtnilsfyrsylrarkaflerigrsdrmenrpfl
llkepktdrqtivagwksefhlprgifteavrdcliemgydevgsyrevgfmakavplyferaced
rvqpfydspfnvgnslkpkkgrflskeeraeewergkerfrdleawshsaarriedafagieyasp
gnkkkieqllrdlslweafesklkvradkinlaklkkeileaqehpyhdflcswqkferelrlyknq
diitwmmerdlmeenkvegldtgtlylkdirtnvqeqgslnylnhvkpmrlpvvvyradsrgh
vhkeeaplatvyieerdtkllkqgnfksfvkdrringlfsfvdtgglameqypisklrveyelakyq
tarvcafeqtleleesslltryphlpdknfrkmleswsdpllakwpelhgkvrlliavrnafshnqyp
mydeavfssirkydpsspdaieermglniahrlseevkqaketveriiqa |
| Porphyromonas gulae | WP_039419792
(SEQ ID NO: 96) | mteqserpyngtyytledkhfwaaflnlarhnayitlthidrqlayskaditndqdvlsflcalwknl
dndlerksrlrslilkhfsflegaaygkklfeskssgnkssknkeltkkekeelqanalsldnlksilfd
flqklkdfrnyyshyrhsgsselplfdgnmlqrlynvfdvsvqrvkrdhehndkvdphrhfnhlv
rkgkkdryghndnpsflchhfvdgegmvteagllffvslflekrdaiwmqkkirgfkggtetyqq
mtnevfcrsrislpklkleslrtddwmlldmlnelvrcpkplydrlrekdrarfrvpvdilpdeddt
dgggedpfkntivrhqdrfpyfalryfdlkkvftslrfhidlgtyhfaiykkvigeqpedrhltrnly
gfgriqdfaeehrpeewkrlyrdldyfetgdkpyisqttphyhiekgkiglrfvpegqhlwpspev
gttrtgrskyaqdkrltaeaflsvhelmpmmfyyfllrekyseevsaekvqgrikrviedvyaiyd
afardeintrdeldacladkgirrghlpkqmigilsqehknmeekvrkklqemiadtdhrldmld
rqtdrkirigrknaglpksgviadwlvrdmmrfqpvakdtsgkpinnskansteyrmlqralalf
ggekerltpyfrqmnitggnnphpfldetrweshtnilsfyrsylrarkaflerigrsdrvenrpflllk
epktdrqtivagwksefhlprgifteavrdcliemgydevgsykevgfmakavplyferackdry
qpfydspfnvgnslkpkkgrflskekraeewesgkerfrlaklkkeileaqehpyhdfkswqkfe
relrlyknqdiitwmmerdlmeenkvegldtgtlylkdirpnvqeqgslnvinrvkpmrlpvvv
yradsrghvhkeeaplatvyieerdtkllkqgnfksfvkdrringlfsfvdtgglameqypisklry
eyelakyqtarvcvfeltlrleesslsryphlpdesfremleswsdpllakwpelhgkvrlliavrnaf
shnqypmydeavfssirkydpsspdaieermglniahrlseevkqaketveriiqa |
| Porphyromonas gulae | WP_039426176
(SEQ ID NO: 97) | mteqserpyngtyytledkhfwaaflnlarhnayitlthidrqlayskaditndqdvlsflcalwknf
dndlerksrlrslilkhfsflegaaygkklfeskssgnkssknkeltkkekeelqanalsldnlksilfd
flqklkdfrnyyshyrhsgsselplfdgnmlqrlynvfdvsvqrvkrdhehndkvdphyhfnhl
vrkgkkdryghndnpsflchhfvdgegmvteagllffvslflekrdaiwmqkkirgfkggtpye
qmtnevfcrsrislpklkleslrtddwmlldmlnelvrcpkplydrlrekdracfrvpvdilpdedd
tdgggedpfkntivrhqdrfpyfalryfdlkkvftslrfhidlgtyhfaiykkmigeqpedrhltrnl
ygfgriqdfaeehrpeewkrlyrdldyfetgdkpyisqttphyhiekgkiglrfmpegqhlwpsp
evgttrtgrskyaqdkrltaeaflsvhelmpmmfyyfllrekyseevsaekvqgrikrvikdvyai
ydafardeintlkeldacsadkgirrghlpkqmigilsqehknmeekvrkklqemiadtdhrld
mldrqtdrkirigrknaglpksgviadwlvrdmmrfqpvakdtsgkpinnskansteyrmlqra
lalfggekerltpyfrqmnitggnnphpfldetrweshtnilsfyrsylrarkaflerigrsdrvenrpf
llllkepkndrqtivagwksefhlprgifteavrdcliemgydevgsykevgfmakavplyferac
kdrvqpfydspfnvgnslkpkkgrflskekraeewesgkerfrlaklkkeileakehpyhdfksw
qkferelrlyknqdiitwmmerdlmeenkvegldtgtlylkdirtvkpmrlp
vvvyradsrghvhkeqaplatvyieerdtkllkqgnflcsfvkdrrlnglfsfvdtgglameqypis
klrveyelakyqtarvcafeqtleleesslltryphlpdenfremleswsdpllgkwpdlhgkvrllia
vrnafshnqypmydeavfssirkydpsspdaieermglniahrlseevkqaketveriiqa |
| Porphyrom onas gulae | WP_039431778
(SEQ ID NO: 98) | mteqserpyngtyytledkhfwaaflnlarhnayitlthidrqlayskaditndqdvlsflcalwknf
dndlerksrlrslilkhfsflegaaygkklfeskssgnkssknkeltkkekeelqanalsldnlksilfd
flqklkdfrnyyshyrhsesselplfdgnmlqrlynvfdvsvqrvkrdhehndkvdphrhfnhlv
rkgkkdryghndnpsflchhfvdgegmvteagllffvslflekrdaiwmqkkirgfkggtetyqq
mtnevfcrsrislpklkleslrtddwmlldmlnelvrcpkplydrleddracfrvpvdilpdeddt
dgggedpfkntivrhqdrfpyfalryfdlkkvftslrfhidlgtyhfaiykkmigeqpedrhltrnly
gfgriqdfaeehrpeewkrlyrdldyfetgdkpyisqtsphyhiekgkiglrfmpegqhlwpspe
vgttrtgrskyaqdkrltaeaflsvhelmpmmfyyfllrekyseevsaekvqgrikrviedvyaiy
dafardeintlkeldacladkgirrghlpkqmiailsgehkdmeekirkklqemiadtdhrldmld
rqtdrkirigrknaglpksgviadwlvrdmmrfqpvakdtsgkplnnskansteyrmlqralalf
ggekkrltpyfrqmnitggnnphpflhetrweshtnilsfyrsylrarkaflerigrsdrmenrpflll
kepktdrqtivagwksefhlprgifteavrdcliemgydevgsyrevgfmakavplyferacedr
vqpfydspfnvgnslkpkkgrflskeeraeewergkerfrdleawshsaarriedafagieyaspg |

TABLE 6-continued

| | | |
|---|---|---|
| | | nkkkieqllrdlslweafesklkvradkinlaklkkeileaqehpyhdflcswqkferelrlyknqdi
itwmmerdlmeenkvegldtgtlylkdirpnvqeqgslnylnrvkpmrlpvvvyradsrghvh
keeaplatvyieerdtkllkqgnfksfvkdrrlnglfsfvdtgglameqypisklrveyelakyqtar
vcvfeltlrleesllltryphlpdesfrkmleswsdpllakwpelhgkvrlliavrnafshnqypmyd
eavfssirkydpsspdaieermglniahrlseevkqaketveriiqv |
| Porphyromonas
gulae | WP_
039437199
(SEQ ID
NO: 99) | mteqserpyngtyytledkhfwaaflnlarhnayitlthidrqlayskaditndedilffkgqwknl
dndlrerksrlrslilkhfsflegaaygkkffeskssgnkssknkeltkkekeelqanalsldnlksilf
dflqklkdfrnyyshyrhsgsselplfdgnmlqrlynvfdvsvqrvkrdhehndevdphyhfnh
lvrkgkkdryghndnpsflchhfvdgegmvteagllffvslflekrdaiwmqkkirgflcggtepy
eqmtnevfcrsrislpklkleslrtddwmlldmlnelvrcpkplydrlrekdracfrvpvdilpded
dtdgggedpfkntivrhqdrfpyfalryfdlkkvftslrfhidlgtyhfaiykkmigeqpedrhltrn
lygfgriqdfaeehrpeewkrlyrdldyfetgdkpyisqttphyhiekgkiglrfvpegqhlwpsp
evgttrtgrskyaqdkrltaeaflsvhelmpmmfyyfllrekyseevsaekvqgrikrviedvyai
ydafardeintlkeldacladkgirrghlpkqmigilsqerkdmeekvrkklqemiadtdhrldm
ldrqtdrkirigrknaglpksgviadwlvrdmmrfqpvakdtsgkplnnskansteyrmlqrala
lfggekerltpyfrqmnitggnnphpflhetrweshtnilsfyrsylrarkaflerigrsdrvencpfll
lkepktdrqtivagwkgefhlprgifteavrdcliemgydevgsyrevgfmakavplyferaced
rvqpfydspfnvgnslkpkkgrflskekraeewesgkerfrlaklkkeileaqehpyhdfkswqk
ferelrlyknqdiitwmmerdlmeenkvegldtgtlylkdirpnvqeqgslnvinrvkpmrlpv
vvyradsrghvhkeeaplatvyieerdtkllkqgnfksfvkdrrlnglfsfvdtgalameqypiski
rveyelakyqtarvcafeqtleleesllltryphlpdesfremleswsdplltkwpelhgkvffliavr
nafshnqypmydeavfssiwkydpsspdaieermglniahrlseevkqaketieriiqa |
| Porphyromonas
gulae | WP_
039442171
(SEQ ID
NO: 100) | mteqserpyngtyytledkhfwaaflnlarhnayitlthidrqlayskaditndqdvlsflcalwknl
dndlrerksrlrslilkhfsflegaaygkklfeskssgnkssknkeltkkekeelqanalsldnlksilfd
flqklkdfrnyyshyrhsgsselplfdgnmlqrlynvfdvsvqrvkrdhehndkvdphyhfnhl
vrkgkkdryghndnpsflchhfvdsegmvteagllffvslflekrdaiwmqkkirgfkggtgpye
qmtnevfcrsrislpklkleslrtddwmlldmlnelvrcpkplydrlrekdracfrvpvdilpdedd
tdgggedpfkntivrhqdrfpyfalryfdlkkvftslrfhidlgtyhfaiykkmigeqpedrhltrnl
ygfgriqdfaeehrpeewkrlyrdldyletgdkpyisqttphyhiekgkiglrfvpegqhlwpspe
vgtttrtgrskcaqdkrltaeaflsvhelmpmmfyyfllrekyseevsaekvqgrikrviedvyaiy
dafardeintlkeldtcladkgirrghlpkqmitilsgerkdmekirkklqemiadtdhrldmldr
qtdrkirigrknaglpksgviadwlvrdmmrfqpvakdasgkpinnskansteyrmlqralalfg
gekerltpyfrqmnitggnnphpflhetrweshtnilsfyrsylrarkaflerigrsdrvencpflllk
epktdrqtivagwkdefhlprgifteavrdcliemgydevgsyrevgfmakavplyferacedry
qpfydspfnvgnslkpkkgrflskedraeewergmerfrdleawshsaarrikdafagieyaspg
nkkkieqllrdlslweafesklkvradkinlaklkkeileaqehpyhdflcswqkferelrlyknqdi
itwmmerdlmeenkvegldtgtlylkdirpnvqeqgslnylnrvkpmrlpvvvyradsrghvh
keaplatvyieerntkllkqgnfksfvkdrringlfsfvdtgglameqypisklrveyelakyqtary
cvfeltlrleesllsryphlpdesfremleswsdpllakwpelhgkvrlliavrnafshnqypmyde
avfssirkydpsspdaieermglniahrlseevkqaketveriiqa |
| Porphyromonas
gulae | WP_
039445055
(SEQ ID
NO: 101) | mntvpatenkgqsrtveddpqyfglylnlarenlieveshvrikfgkkklneeslkqsllcdhllsid
rwtkvyghsrrylpflhcfdpdsgiekdhdsktgvdpdsaqrlirelyslldflrndfshnrldgttfe
hlkvspdissfitgaytfaceraqsrfadffkpddffllaknrkeqlisvadgkecltvsgfafficlfldr
eqasgmlsrirgfkrtdenwaravhetfcdlcirhpdrlessntkeallldmlnelnrcprilydml
peeeraqflpaldensmnnlsenslneesrllwdgssdwaealtkrirhqdrfpylmlrfieemdll
kgirfrvdlgeieldsyskkvgrngeydrtitdhalafgklsdfqneeeevsrmisgeasypvrfslfa
pryaiydnkigychtsdpvypksktgekralsnpqsmgfisvhdlrklllmellcegsfsrmqsdf
lrkanrildetaegklqfsalfpemrhrfippqnpkskdrrekaettlekykqeikgrkdklnsqlls
afdmnqrqlpsrlldewmnirpashsvklrtyvkqlnedcrlrlrkfrkdgdgkaraiplvgemat
flsqdivrmiiseettkklitsayynemqrslaqyageennrrqfraivaelhlldpssghpflsatmet
ahrytedffykcylekkrewlaktfyrpeqdentkrrisvffvpdgearklllllirrrmkeqndlqd
wirnkqahpidlpshlfdskimellkykdgkkkwneafkdwwstkypdgmqpfyglrrelni
hgksysyipsdgkkfadcythlmektvrdkkrelrtagkpvppdlaayikrsfhravnerefmlrl
vqeddrlmlmainkmmtdreedilpglknidsildeenqfslavhaklvlekegeggdnslslvp
atieikskrkdwskyiryrydrrvpglmshfpehkatldevktllgeydrcrikifdwafalegaim
sdrdlkpylhessregksgehstivkmlvekkgcltpdesqylilirnkaahnqfpcaaemrpliy
rdvsakvgsiegssakdlpegsslvdslwkkyemiirkilpildhenrffgkllnnmsqpindl |
| Capnocyto
phaga
cynodegmi | WP_
041989581
(SEQ ID
NO: 102) | menktslgnniyynpfkpqdksyfagylnaamenidsvfrelgkrlkgkeytsenffdaifkeni
slveyeryvkllsdyfpmarlldkkevpikerkenflcknfrgiikavrdlrnfythkehgeveitde
ifgvldemlkstvltykkkkiktdktkeillksiekqldilcqkkleylkdtarkieekrrnqrergek
klvprfeysdrrddliaaiyndafdvyidkkkdslkesskktkyntesypqqeegdlkipiskngvv
fllslflskqevhafkskiagfkatvideatvshrknsicfmatheifshlaykklkrkvrtaeinyse
aenaeqlsiyavektlmmqmldelskvpdvvyqnlsedvqktfiedwneylkenngdvgtmee
eqvihpvirkryedkfnyfairflndefaqfptlrfqvhlgnylhdsrpkehlisdrrikekitvfgrlse
lehkkalfiknetnedrkhywevfpnpnydfpkenisvndkdfpiagsildrekqptagkigik
vnllnqkyisevdkavkahqlkqrnnkpsigniieeivpingsnpkeiivfggqptaylsmndih
silyeffdkwekkkeklekkgekelrkeigkeleekivgkiqtqiqqiidkdinakilkpyqddds
taidkeklikdlkqeqkilqklkneqtarekeyqeciayqeesrkikrsdksrqkylrnqlkrkype
vptrkeilyyqekgkvavwlandikrfmptdfknewkgeqhsllqkslayyeqckeelknllpq
qkvfkhlpfelgghfqqkylyqfytryldkrlehisglvqqaenfknenkvfkkvenecfkflkkq
nythkgldaqaqsvlgypiflergfmdekptiikgktfkgnesliftdwfryykeyqnfqtfydten
yplvelekkqadrkretkiyyqqkkndvifilmakhiflcsvfkqdsidrfsledlyqsreerrlenqek
akqtgerntnyiwnktvdlnlcdgkvtvenvklknvgnfikyeydqrvqtflkyeenikwqafli
keskeeenypyiverieqyekvrreellkevhlieeyilekvkdkeilkkgdnqnfkyyilngllk
qlknedvesykvfnlntkpedvninqlkqeatdleqkafvltyirnkfahnqlpkkefwdycqek
ygkiekektyaeyfaevflcrekealmk |

TABLE 6-continued

| Prevotella sp. P5-119 | WP_042518169 (SEQ ID NO: 103) | mnipalvenqkkyfgtysvmamlnaqtvldhiqkvadiegeqnennenlwfhpvmshlyna kngydkqpektmfiierlqsyfpflkimaenqreysngkykqnrvevnsndifevlkrafgvlk myrdltnhyktyeeklidgcefltsteqplsgmiskyytvalrntkerygyktedlafiqdnikkitk daygkrksqvntgfflslqdyngdtqkklhlsgvgialliclfldkqyiniflsrlpifssynaqseerr iiirsfginsiklpkdrihseksnksvamdmlnevkrcpdelftttlsaekqsrfriiisddhnevlmkr stdrfvplllqyidygklfdhirfhvnmgklryllkadktcidgqtrvrvieqpingfgrleeaetmr kqengtfgnsgirirdfenvkrddanpanypyivdtythyilennkvemfisdkgssapllplied dryvvktipscrmstleipamafhmflfgskkteklivdvhnrykrlfqamqkeevtaeniasfgi aesdlpqkildlisgnahgkdvdafirltvddmltdterrikrflcddrksirsadnkmgkrgfkqiSt gkladflakdivlfqpsyndgenkitglnyrimqsaiavydsgddyeakqqfklmfekarligkg ttephpflykvfarsipanavdfyerylierkfyltglcneikrgnrvdvpfirrdqnkwktpamktl griysedlpvelprqmfdneikshlkslpqmegidfnnanytyliaeymkrvinddfqtfyqwk rnyhymdmlkgeydrkgslqhcftsveeregkwkerasrteryrklasnkirsnrqmrnasseei etildkrlsncrneyqksekvirryrvqdallfllakkttleladfdgerfklkeimpdaekgilseim pmsftfekggkkytitsegmklknygdffvlasdkrignllelvgsdivskedimeefnkydqcr peissivfnlekwafdtypelsarvdreekvdflcsilkillnnkninkeqsdilrkirnafdhnnypd kgiveikalpeiamsikkafgeyaimk |
| Prevotella sp. P4-76 | WP_044072147 (SEQ ID NO: 104) | mnipalvenqkkyfgtysvmamlnaqtvldhiqkvadiegeqnennenlwfhpvmshlyna kngydkqpektmfiierlqsyfpflkimaenqreysngkykqnrvevnsndifevlkrafgvlk myrdqashyktydeklidgcefltsteqplsgminnyytvalrnmnerygyktedlafiqdkrfkf vkdaygkkksqvntgfflslqdyngdtqkklhlsgvgialliclfldkqyiniflsrlpifssynaqse erriiirsfginsikqpkdrihseksnksvamdmlneikrcpnelfetlsaekqsrfriisndhnevl mkrssdrfvplllqyidygklfdhirfhvnmgklryllkadktcidgqtrvrvieqpingfgrleev etmrkqengtfgnsgirirdfenmkrddanpanypyivdtythyilennkvemfisdeetpapll pviedddryvvktipscrmstleipamafhmflfgskkteklivdvhnrykrlfkamqkeevtaen iasfgiaesdlpqkiidlisgnahgkdvdafirltvddmladterrikrfkddrksirsadnkmgkrg fkqistgkladflakdivlfqpsvndgenkitglnyrimqsaiavynsgddyeakqqfklmfekar ligkgttephpflykvfvrsipanavdfyerylierkfyliglsneikkgnrvdvpfirrdqnkwktp amktlgriydedlpvelprqmfdneikshlkslpqmegidfnnanytyliaeymkrvinddfqtf yqwkrnyrymdmlrgeydrkgslqscftsveeregkwkerasrteryrklasnkirsnrqmrnas seeietildkrlsnsrneyqksekvirryrvqdallfllakkttleladfdgerfklkeimpdaekgils eimpmsftfekggkkytitsegmklknygdffvlasdkrignllelvgsdtvskedimeefkkyd qcrpeissivfnlekwafdtypelsarvdreekvdflcsilkillnnkninkeqsdilrkirnafdhnn ypdkgvveiralpeiamsikkafgeyaimk |
| Prevotella sp. P5-60 | WP_044074780 (SEQ ID NO: 105) | mnipalvenqkkyfgtysvmamlnaqtvldhiqkvadiegeqnennenlwfhpvmshlyna kngydkqpektmfiierlqsyfpflkimaenqreysngkykqnrvevnsndifevlkrafgvlk myrdltnhyktyeeklidgcefltsteqpfsgmiskyytvalrntkerygykaedlafiqdnrykft kdaygkrksqvntgsflslqdyngdttkklhlsgvgialliclfldkqyinlflsrlpifssynaqseer riiirsfginsikqpkdrihseksnksvamdmlnevkrcpdelftttlsaekqsrfriisddhnevlm krssdrfvplllqyidygklfdhirfhvnmgklryllkadktcidgqtrvrvieqpingfgrleevet mrkqengtfgnsgirirdfenmkrddanpanypyivetythyilennkvemfisdeenptpllpv ieddryvvktipscrmstleipamafhmflfgsekteklivdvhdrykrlfqamqkeevtaeniasn fgiaesdlpqkimdlisgnahgkdvdafirltvddmltdterrikrfkddrksirsadnkmgkrgf kqistgkladflakdivlfqpsyndgenkitglnyrimqsaiavydsgddyeakqqflclmfekarl igkgttephpflykvfvrsipanavdfyerylierkfyliglsneikkgnrvdvpfirrdqnkwktp amktlgriysedlpvelprqmfdneikshlkslpqmegidfnnanytyliaeymkrvinddfqtf yqwkrnyrymdmlrgeydrkgslqhcftsieeregkwkerasrteryrklasnkirsnrqmrnas seeietildkrlsncrneyqksekiirryrvqdallfllakkttleladfdgerfklkeimpdaekgilse impmsftfekggkiytitsggmklknygdffvlasdkrignllelvgsntvskedimeeficykydq crpeissivfnlekwafdtypelparvdrekvdfwsildvlsnnkdinneqsyilrkirnafdhnn ypdkgiveikalpeiamsikkafgeyaimk |
| Phaeo-dactylibacter xiamenensis | WP_044218239 (SEQ ID NO: 106) | mtntpkrrtlhrhpsyfgaflniarhnafmimehlstkydmedkntldeaqlpnaklfgclkkryg kpdvtegvsrdlrryfpflnyplflhlekqqnaeqaatydinpediefltlkgffrrllnqmrnnyshyi sntdygkfdklpvqdiyeaaiffildrgkhtkrfdvfeskhtrhlesnnseyrprslanspdhentva fvtclflerkyafpslrldcfrstndaaegdplirkasheecytmfccrlpqpklessdilldmvnelg rcpsalynllseedqarfhikreeitgfeedpdeeleqeivlkrhsdrfpyfalryfddteafqtlrfdv ylgrwrtkpvykkriymerdryltqsirtftrlsrllpiyenvkhdavrqneedgklvnpdvtsqfh kswiqiesddraflsdriehfsphynfgdqviglkfinpdryaaiqnvfpklpgeekkdkdaklvn etadaiistheirslflyhylskkpisagderrfiqvdtetfikqyidtiklffediksgelqpiadppny qkneplpyvrgdkektqeeraqyrerqkeikerrkelntllqnryglsiqyipsrlreyllgykkvp yeklalgklraqrkevkkrikdiekmrtprvgeqatwlaedivfltppkmhtperkttkhpqklnn dqfrimqsslayfsvnkkaikkffqketgiglsnretshpflyridvgrcrgildfytgylykymdw lddaikkvdnrkhgkkeaklyekylpssiqhktpleldytrlpvylprglfkkaivkalaahadfq vepeednvifcldqlldgdtqdfynwqryyrsalteketdnqlvlahpyaeqilgtiktlegkqknn klgnkakqkikdelidlkrakrrlldreqylravqaedralwlmiqerqkqkaeheeiafdqldlkn itkilltesidarlripdtkvditdklplrrygdlrrvakdrrlvnlasyyhvaglseipydlvkkeleey drrvaffehvqfekevydryaaelmenpkgestyfshweyvavavkhsadthfnelfkekv mqlrnkfhhnefpyfdwllpevekasaalyadrvfdvaegyyqkmrklmrq |
| Flavobacterium sp. 316 | WP_045968377 (SEQ ID NO: 107) | mdnnitvektelglgitynhdkvedkhyfggffnlaqnnidlvaqeflckrlliqgkdsinifanyfs dqcsitnlergikilaeyfpvvsyidlleknksksirehlillletinnlrnyythyyhkkiiidgslfpl ldtillkvvleikkkklkedktkqllkkglekemtilfnlmkaeqkekkikgwnidenikgavinr afshllyndelsdyrksknytededtlkdttesgilfllsifinkkeqeqlkanikgykgkiasipdeei tlknnslrnmathwtyshltykglkhriktdheketllvnmvdylskvpheiyqnlseqnkslfle dineymrdneenhdsseasrvihpvirkryenkfayfairfldefaefptlrfmvnvgnyihdnrk kdiggtslitnrtikqqinvfgniteihkkkndyfekeenkektlewelfpnpsyhfqkenipifidl |

| | | |
|---|---|---|
| | | eksketndlakeyakekkkifgssrkkqqntakknretiinlvfdkyktsdrktvtfeqrptallsfne<br>lnsflyaflvenktgkelekiiiekianqyqilkncsstvdktndnipksikkivntttdsfyfegkki<br>dieklekditieiektneklletikeneesaqnykrnerntqkrklyrkyvfftneigieatwitndilrf<br>ldnkenwkgyqhselqkfisqydnykkealglllesewnlesdaffgqnlkrmfqsnstfetfykk<br>yldnrkntletylsaienlktmtdvrpkvlkkkwtelfrffdkkiyllstietkinelitkpinlsrgife<br>ekptfingknpnkennqhlfanwfiyakkqtilqdfynlpleqpkaitnlkkhhkyklersinnlkie<br>diyikqmvdflyqklfeqsfigslqdlytskekreiekgkakneqtpdesfiwkkqveinthngrii<br>aktkikdigkflailltdnkiahlisyddriwdfslnndgditkklysintelesyetirrekllkqiqqf<br>eqfllegeteysaerkhpekfekdcnpnflckyiiegvinkiipnheieeieilkskedvfkinfsdili<br>lnnddnikkgyllimirnkfahnqlidknlfnfslqlysknenenfseylnkvcqniiqefkeklk |
| Porphyromonas gulae | WP_046201018 (SEQ ID NO: 108) | mteqserpyngtyytledkhfwaaflnlarhnayitlthidrqlayskaditndqdvlsflcalwknf<br>dndlerksrlrslilkhfsflegaaygkklfeskssgnksskneltkkekeelqanalsldnlksilfd<br>flqklkdfrnyyshyrhsesselplfdgnmlqrlynvfdvsvqrvkrdhehndkvdphrhfnhlv<br>rkgkkdryghndnpsflchhfvdsegmvteagllffvslflekrdaiwmqkkirgfkggtetyqq<br>mtnevfcrsrislplklkleslrtddwmlldmlnelvrcpkplydrlrekdrarfrvpvdilpdeddt<br>dgggedpfkntivrhqdrfpyfalryfdlkkvftshidlgtyhfaiykkmigeqpedrhltrnly<br>gfgriqdfaeehrpeewkrlyrdldyfetgdkpyisqttphyhiekgkiglrfmpegqhlwpspe<br>vgttrtgrskyaqdkrltaeaflsvhelmpmmfyyfllrekyseevsaekvqgrikrviedvyaiy<br>dafardeintlkeldacladkgirrghlpkqmiailsgehkdmeekirkklqemiadtdhrldmld<br>rqtdrkirigrknaglpksgviadwlvrdmmrfqpvakdtsgkpinnskansteyrmlqralalf<br>ggekkrltpyfrqmnitgggnnphpflhetrweshtnilsfyrsylrarkaflerigrsdrmenrpflll<br>kepktdrqtivagwksefhlprgifteavrdcliemgydevgsyrevgfmakavplyferacedr<br>vqpfydspfnvgnslkpkkgrflskeeraeewergkerfrdleawshsaarriedafagieyaspg<br>nkkkieqllrdlslweafesklkvradkinlaklkkeilaqehpyhdflcswqkferelrlyknqdi<br>itwmmerdlmeenkveggldtgtlylkdirpnvqeqgslnylnrvkpmrlpvvvyradsrghvh<br>keeaplatvyieerdtkllkqgnfksfvkdrringlfsfvdtgglameqypisklrveyelakyqtar<br>vcvfeltbleesllltryphlpdesfrkmleswsdpllakwpelhgkvrlliavrnafshnqypmyd<br>eavfssirkydpsspdaieermglniahrlseevkqaketveriiqv |
| WP_047431796 | Chryseobacterium sp. YR477 (SEQ ID NO: 109) | metqfighgiaydhskiqdkhffggfinlaennikavlkafsekfnvgnvdvkqfadvslkdnlp<br>dndfqkrvsflkmyfpvvdfinipnnrakfrsdlttlfksvdqlrnfythyyhkpldfdaslfilldi<br>fartakevrdqkmkddktrqllskslseelqkgyelqlerlkelnrlgkkvnihdqlgikngvinna<br>fnhliykdgesfktkltyssaltsfesaengieisqsgllfllsmflkrkeiedlknrnkgfkakvvide<br>dgkvnglkfmathwvfsylcflclcgklskstefheetlliqiidelskvpdelycafdketrdkfiedi<br>neyvkeghqdfsledakvihpvirkryenkfnyfairfldefvkfpslrfqvhvgnyvhdrrikni<br>dgttfeterrvvkdrikvfgrlseissyykaqylssysdkhdetgweifpnpsyvfinnnipihisvdts<br>fkkeiadfkklrraqvpdelkirgaekkrkfeitqmgiskgsvinqeepiallslneipallyeilingk<br>epaeieriikdklnerqdviknynpenwlpasqisrrlrsnkgeriiintdkllqlvtkellvteqklkii<br>sdnrealkqkkegkyirkfiftnselgreaiwladdikrfmpadvrkewkgyqhsqlqqslafyn<br>srpkealailessswnlkdekiiwnewilksftqnkffdafyneylkgrkkyfaflsehivqytsnak<br>nlqkfikqqmpkdlfekrhyiiedlqteknkilskpfifprgifdkkptfikgvkvedspesfanw<br>yqygyqkdhqfqkfydwkrdysdvflehlgkpfinngdrrtlgmeelkeriiikqdlkikkikiq<br>dlflrliaenlfqkvflcysaklplsdfyltqeermekenmaalqnvreegdkspniikdnfiwskm<br>ipykkgqiienavklkdigklnvlslddkvqtllsyddakpwskialenefsigensyevirrrekif<br>keiqqfeseilfrsgwdginhpaqlednrnpkfkmyivngilrksaglysqqediwfeynadfnn<br>ldadvletkselvqlaflvtairnkfahnqlpakefyfyirakygfadepsvalvylnftkyainefk<br>kvmi |
| Riemerella anatipestifer | WP_049354263 (SEQ ID NO: 110) | mffsfhnaqrvifkhlykafdaslrmykedykahftvnitrdfahlnrkgknkqdnpdfnryrfe<br>kdgfftesgllfftnlfldkrdaywmlkkvsgfkashkqrekmttevfcrsrillpklrlesrydhnq<br>mlldmlselsrcpkllyeklseenkkhfqveadgfldeieeeqnpfkdtlirhqdrfpyfalrylydln<br>esflcsirfqvdlgtyhyciydkkigdeqekrhltrtllsfgrlqdfteinrpqewkaltkdldyketsn<br>qpfiskttphyhitdnkigftrlgtskelypsleikdganriakypynsgfvahafisvhellpmfyq<br>hltgksedllketvrhiqriykdfeeeerintiedlekanqgrlplgafpkqmlgllqnkqpdlsekak<br>ikiekliaetklllshrintklksspkglgkrreklikgvladwlvkdfmrfqpvaydaqnqpiksska<br>nstefwfirralalyggeknrlegyfkqtnlligntnphpflnkfnwkacrnlvdfyqqylegrekfl<br>eaiknqpwepyqyclllkipkenrknlvkgweqggislprglfteairetlsedlmlskpirkeikk<br>hgrvgfisraitlyfkekyqdkhqsfynlsyklekakapllkreehyeyqqnkpqsptesqrlelht<br>sdrwkdyllykrwqhlekkklryrnqdvmlwlmtleltlknhfkelnlnyhqlklenlavnvqea<br>daklnpingtlpmvlpvkvypatafgevqyhktpirtvyireehtkalkmgnflcalvkdrringlf<br>sfikeendtqkhpisqlrlrreleiyqslrydaflcetlsleekllnkhtslsslenefralleewkkeyaa<br>ssmvtdehiafiasvrnafchnqypfykealhapiplfttvaqptteekdglgiaeaalllkvlreyceiv<br>ksqi |
| Porphyromonas gingivalis | WP_052912312 (SEQ ID NO: 111) | mteqnekpyngtyytledkhfwaaffnlarhnayitlahidrqlayskaditndedilfflcgqwkn<br>ldndlerkarlrslilkhfsflegaaygkklfesqssgnksskkelltkkekeelqanalsldnlksilf<br>dflqklkdfrnyyshyrhpesselplfdgnmlqrlynvfdvsvqrvkrdhehndkvdphrhfnhl<br>vrkgkkdkygnndnpfflchhfvdreekvteagllffvslflekrdaiwmqkkirgfkggteayq<br>qmtnevfcrsrislpklkleslrtddwnilldmlnelvrcpllydrlreedrarfrvpvdilsdeddt<br>dgteedpfkntivrhqdrfpyfalryfdlkkvftshidlgtyhfaiykkmigeqpedrhltrnlyg<br>fgriqdfaeehrpeewkrlvrdldyfetgdkpyitqttphyhiekgkiglrfvpegqllwpspevg<br>atrtgrskyaqdkrftaeaflsvhelmpmmfyyfllrekyseeasaekvqgrikrviedvyavyd<br>afardeintrdeldacladkgirrghlprqmiailsqehkdmeekvrkklqemiadtdhrldmdr<br>qtdrkirigrknaglpksgviadwlvrdmmrfqpvakdtsgkpinnskansteyrmlqralalfg<br>gekerltpyfrqmnitggnnphpflhetrweshtnilsfyrsylrarkaflqsigrsdreenhrflllk<br>epktdrqtivagwksefhlprgifteavrdcliemgydevgsykevgfmakavplyferackdry<br>qpfydypfnvgnslkpkkgrflskekraeewesgkerfrdleawshsaarriedafvgieyaswe<br>nkkkieqllqdlslwetfesklkvkadkiniaklkkeileakehpyhdfkswqkferelrlvknqd<br>iitwmmerdlmeenkveggldtgtlylkdirtdvqeqgslnylnhvkpmflpvvvyradsrghv |

TABLE 6-continued

| | | |
|---|---|---|
| | | hkeeaplatvyieerdtkllkqgnfksfvkdrringlfsfvdtgalameqypisklrveyelakyqta rvcafeqtleleeesllltryphlpdesfremleswsdplldkwpdlqrevrllliavrnafshnqypmy detifssirkydpssldaieermglniahrlseevklakemveriiqa |
| *Porphyromonas gingivalis* | WP_ 058019250 (SEQ ID NO: 112) | mteqnekpyngtyytlkdkhfwaaffnlarhnayitlthidrqlayskaditndedilffkgqwkn ldndlerkarlrslilkhfsflegaaygkklfesqssgnksskkkeltkkekeelqanalsldnlksilf dflqklkdfrnyyshyrhpesselpmfdgnmlqrlynvfdvsvqrvkrdhehndkvdphrhfn hlvrkgkkdregnndnpfflchhfvdregkvteagllffvslflekrdaiwmqkkirgflcggtetyq qmtnevfcrsrislpklkleslrtddwnilldmlnelvrcpkslydrlreedracfrvpvdilsdeddt dgaeeedpflcntivrhqdrfpyfalryfdlkkvftslrfhidlgtyhfaiykknigeqpedrhltrnlyg fgriqdfaeehrpeewkrlyrdldcfetgdkpyitqttphyhiekgkiglrfvpegqhlwpspevg atrtgrskyaqdkrftaeaflsvhelmpmmfyyfllrekyseevsaervqgrikrviedvyavyda fardeintrdeldacladkgirrghlprqmiailsqkhkdmeekvrkklqemiadtdhrldmldrq tdrkirigrknaglpksgviadwlvrdmmrfqpvakdtsgkpinnskansteyrmlqralalfgg ekerltpyfrqmnitggnnphpflhetrweshtnilsfyrsylkarkaflqsigrsdrvenhrflllke pktdrqtivagwkgefhlprgifteavrdcliemgldevgsykevgfmakavplyferackdryq pfydypfnvgnslkpkkgrflskekraeewesgkerfrdleawshsaarriedafagienasrenk kkieqllqdlslwetfesklkvkadkiniaklkkeileakehpyldflcswqkferelrlyknqdiit wmmerdlmeenkvegldtgtlylkdirtdvqeqgslnylnhvkpmrlpvvvyradsrghvhk eqaplatvyieerdtkllkqgnfksfvkdrringlfsfvdtgalameqypisklrveyelakyqtary cafeqtleleeesllltryphlpdenfrkmleswsdplldkwpdlhrkvrlliavrnafshnqypmyd eavfssirkydpsspdaieermglniahrlseevkqakemaeriiqa |
| *Flavobacterium columnare* | WP_ 060381855 (SEQ ID NO: 113) | mssknesynkqktfnhykqedkyffggfinnaddnlrqvgkefktrinfnhnnnelasvfkdyf nkeksvakrehalnllsnyfpvleriqkhtnhnfeqtreifellldtikklrdyythhyhkpitinpkv ydflddtlldvlitikkkkvkndtsrellkekfrpeltqlknqkreelikkgkkllleenlenavfnhclr pfleenktddkqnktvslrkyrkskpneetsitltqsglvflisifihrkefqvftsglegfkakvntik eeeislnknnivymithwsysyynfkglkhriktdqgvstleqnntthsltntntkealltqivdyls kvpneiyetlsekqqkefeedineymrenpenedstfssivshkvirkryenkfnyfamrfldey aelptlrfmvnfgdyikdrqkkilesiqfdseriikkeihlfeklglvteykknvylketsnidlsrfpl fpspsyvmannnipfyidsrsnnldeylnqkkkaqsqnrkrnitfekynkeqskdaiiamlqkei gykdlqqrstigllscnelpsmlyevivkdikgaelenkiaqkireqyqsirdfffldspqkdniptttlt ktistdtsvtfenqpidiprlknalqkeltitqeklinvkqheievdnynrnkntykfknqpkdkvd dnklqrkyvfyrneigqeanwlasdlihfmknkslwkgymhnelqsflaffedkkndciallletv fnlkedciltkdlknlflkhgnfidfykeylklkedflntestflengfiglppkilkkelskrinyifiv fqkrqfiikeleekknnlyadainlsrgifdekptmipflckpnpdefaswfvasyqynnyqsfyel tpdkiendkkkkyknlrainkvkiqdyylklmvdtlyqdlfnqpldkslsdfyvsktdrekikad akaygkrndsflwnkvihlslqnnritanpklkdigkykralqdekiatlltyddrtwtyalqkpek enendykelhytalnmelqeyekvrskkllkqvqelekqildkfydfsnnathpedleieddkkgk rhpnfklyitkallkneseiinlenidieilikyydynteklkekiknmdedekakivntkenynkit nvlikkalvliiirnkmahnqyppkfiydlatrfvpkkeeeyfacyfnrvfetittelwenkkkake iv |
| *Porphyromonas gingivalis* | WP_ 061156470 (SEQ ID NO: 114) | mteqnerpyngtyytledkhfwaaffnlarhnayitlthidrqlayskaditndedilffkgqwknl dndlerkarlrslilkhfsflegaaygkklfenkssgnksskkkeltkkekeelqanalsldnlksilf dflqklkdfrnyyshyrhpesselplfdgnmlqrlynvfdvsvqrvkrdhehndkvdphrhfnhl vrkgkkdregnndnpffichhfvdregkvteagliffvslflekrdaiwmqkkirgflcggteayqq mtnevfcrsrislpklkleslrtddwmildmlnelvrcpkslydrlreedrarfrvpvdilsdeddtd gteedpfkntivrhqdrfpyfalryfdlkkvftslrfhidlgtyhfaiykknigeqpedrhltrnlygf griqdfaeehrpeewkrivrdldyfetgdkpyitqttphyhiekgkiglrfvpegqhlwpspevga trtgrskyaqdkrltaeaflsvhelmpmmfyyfilrekyseevsaekvqgrikrviedvyavydaf argeidtldrldacladkgirrghlprqmiailsqehkdmeekvrkklqemiadtdhrldmldrqt drkirigrknaglpksgviadwlvrdmmrfqpvakdtsgkpinnskansteyrmlqralalfgge kerltpyfrqmnitggnnphpflhetrweshtnilsfyrsylkarkafiqsigrsdreenhrifilkep ktdrqtivagwksefhlprgifteavrdcliemgydevgsykevgfmakavplyferackdrvq pfydypfnvgnslkpkkgrflskekraeewesgkerfrlaklkkeileakehpyldfkswqkfer elrlyknqdiitwmmerdlmeenkvegldtgtlylkdirtevqeqgslnvinrvkpmrlpvvvyr adsrghvhkeqaplatvyieerdtkllkqgnfksfvkdrringlfsfvdtgglameqypisklrvey elakyqtarvcafeqtleleeesllltrcphlpdenfrkmleswsdplldkwpdlqrevwlliavrnaf shnqypmydeavfssirkydpsspdaieermglniahrlseevkqakemaeriiqa |
| *Porphyromonas gingivalis* | WP_ 061156637 (SEQ ID NO: 115) | mntvpasenkgqsrtveddpqyfglylnlarenlieveshvrikfgkkklneeslkqslicdhilsv drwtkvyghsrrylpflhyfdpdsqiekdhdsktgvdpdsaqrlirelyslldfirndfshnridgttf ehlevspdissfitgtyslacgraqsrfadffkpddfvlaknrkeqlisvadgkecltvsglafficlfl dreqasgmlsrirgfkrtdenwaravhetfcdlcirhphdrlessntkeallidmlnelnrcprilyd mlpeeeraqflpaldensmnnlsenslneesrliwdgssdwaealtkrirhqdrfpylmlrfieem dllkgirfrvdlgeieldsyskkvgrngeydrtitdhalafgklsdfqneeevsrmisgeasypvrfs lfapryaiydnkigychtsdpvypksktgekralsnpqsmgfisvhdlrklllmellcegsfsrmq sgflrkanrildetaegklqfsalfpemrhrfippqnpkskdrrekaettlekykqeikgrkdklnsq llsafdmnqrqlpsrlldewmnirpashsvklrtyvkqlnedcrlrlrkfrkdgdgkaraiplvge matflsqdivrrmiiseetkklitsayynemqrslaqyageenrrqfraivaelhlldpssghpflsat metahrytedfykcylekkrewlaktfyrpeqdentkrrisvffvpdgearkllpllirrrmkeqnd lqdwirnkqahpidlpshlfdskimellkvkdgkkkwneafkdwwstkypdgmqpfyglrre lnihgksysyipsdgkkfadcythlmektvqdkkrelrtagkpvppdlaadikrsfhravneref mlrlvqeddrlmlmainkmmtdreedilpglknidsildkenqfslavhakvlekegeggdnsl slvpatieikskrkdwskyiryrydrrvpglmshfpehkatldevktllgeydrcrikifdwafale gaimsdrdlkpylhesssregksgehstivkmlvekkgcltpdesqyliliirnkaahnqfpcaae mpliyrdvsakvgsiegssakdlpegsslvdslwkkyemiirkilpildpenrffgkllnnmsqpi ndl |

TABLE 6-continued

| | | |
|---|---|---|
| *Riemerella anatipestifer* | WP_ 061710138 (SEQ ID NO: 116) | mffsfhnaqrvifkhlykafdaslrmvkedykahftvnitrdfahlnrkgknkqdnpdfnryrfe kdgffftesgllfftnlfldkrdaywmlkkvsgfkashkqsekmttevfcrsrillpklrlesrydhnq mlldmlselsrcpkllyekl sekdkkcfqveadgfldeieeeqnpfkdtlirhqdrfpyfalryldln esfksirfqvdlgtyhyciydkkigyeqekrhltrtllnfgrlqdfteinrpqewkaltkdldynetsn qpfisktttphyhitdnkigifirtskelypslevkdganriakypynsdfvahafisisvhellplmf yqhltgksedllketvrhiqriykdfeeerintiedlekanqgrlplgafpkqmlgllqnkqpdlsek akikiekliaetkllshrintklkssspklgkrrekliktgvladwlvkdfmrfqpvvydaqnqpikss kanstesrlirralalyggeknrlegyfkqtnligntnphpflnkfnwkacrnlvdfyqqylegekf leaikhqpwepyqyclllkvpkenrknlvkgweqggislprglfteairetlskdltlskpirkeikk hgrvgfisraitlyfkekyqdkhqsfynlsykleakaplllkkeehyeywqqnkpqsptesqrlelh tsdrwkdyllykrwqhlekklrlyrnqdimlwlmtleltknhfkelnlnyhqlklenlavnvqea daklnpinqtlpmvlpvkvypttafgevqyhetpirtvyireeqtkalkmgnfkalvkdrhlnglf sfikeendtqkhpisqlrlrreleiyqslrydafketlsleekllnkhaslsslenefrtlleewkkkyaa ssmvtdkhiafiasvrnafchnqypfyketlhapillIftvaqptteekdglgiaeeallrylreyceivk sqi |
| *Flavobacterium columnare* | WP_ 063744070 (SEQ ID NO: 117) | mssknesynkqkt fnhykqedkyffggflnnaddnlrqvgkefktrinfnhnnnelasvfkdyf nkeksvakrehalnllsnyfpvleriqkhtnhnfeqtreifellldtikklrdyythhyhkpitinpki ydflddtlldvlitikkkkvkndtsrellkeklrpeltqlknqkreelikkgkkllleenlenavfnhclr pfleenktddkqnktvslrkyrkskpneetsitltqsglvflmsifihrkefqvftsglegfkakvnti keekislnknnivymithwsysyynfkglvhriktdqgvstleqnntthsltntntkealltqivdyl skvpneiyetlsekqqkefeedineymrenpenedstfssivshkvrirkryenkfnyfamrfide yaelptlrfmvnfgdyikdrqkkilesiqfdseriikkeihlfeklglvteykknvylketsnidlsrf plfpspsyvmannnipfyidsrsnnldeylnqkkkaqsqnrkrnitfekynkeqskdaiiamlqk eigvkdlqqrstigllscnelpsmlyevivkdikgaelenkiaqkireqyqsirdftlnspqkdnipt tliktistdtsvtfenqpidiprlknaiqkelaltqekllnvkqheievnnynrnkntykfknqpkdk vddnklqrkyvfyrneigqeanwlasdlihfmknkslwkgymhnelqsflaffedkkndciall etvfnlkedciltkdlknlflkhgnfidfykeylklkedflntestflengfiglppkilkkelskrinyi fivfqkrqfiikeleekknnlyadainlsrgifdekptmipfkbknpdefaswfvasyqynnyqsf yeltpdkiendkkkkyknlrainkvkiqdyylklmvdtlyqdlfnqpldkslsdfyvsktdrekik adakayqkrndsflwnkvihlslqnnritanpklkdigkykralqdekiatlltyddrtwtyalqkp ekenendykelhytalnmelqeyekvrskklIkqvqelekqildkfydfsnnathpedleiedkk gkrhpnfklyitkallkneseiinlenidieilikyydynteklkekiknmdedekakivntkenyn kitnvlikkalvliiirnkmahnqyppkfiydlatrfvpkkeeeyfacyfnrvfetittelwenkkka keiv |
| *Riemerella anatipestifer* | WP_ 064970887 (SEQ ID NO: 118) | mekplppnvytlkhkffwgaflniarhnafitichineqlgltttppnddkiadvvcgtwnnilnnd hdllkksqltelilkhfpfflaamcyhppkkegkkkgsqkeqqkekeneaqsqaealnpselikvl ktivkqlrtlrnyyshhshkkpdaekdifkhlykafdaslrmvkedykahftvnitqdfahlnrkg knkqdnpdfdryrfekdgffftesgllfftnlfldkrdaywmlkkvsgfkashkqsekmttevfcrs rillpklrlesrydhnqmlldmlselsrypkllyekl seedkkrfqveadgfldeieeeqnpfkdtlir hqdrfpyfalryldlnesfksirfqvdlgtyhyciydkkigdeqekrhltrtllsfgrlqdfteinrpqe wkaltkdldyketskqpfisktttphyhitdnkigifigtskelypslevkdganriaqypynsdfva hafisvhellplmfyqhltgksedllketvrhiqriykdfeeerintiedlekanqgrlplgafpkqm lgllqnkqpdlsekakikiekliaetkllshrintklkssspklgkrrekliktgvladwlvkdfmrfqp vaydaqnqpiesskanstefqliqralalyggeknrlegyfkqtnligntnphpflnkfnwkacrnl vdfyqqylecrekfleaiknqpwepyqyclllkipkenrknlvkgweqggislprglfteairetls kdltlskpirkeikkhgrvgfisraitlyfrekyqddhqsfydlpykleakasplpkkehyeywqq nkpqsptelqrlelhtsdrwkdyllykrwqhlekklrlyrnqdvmlwlmtleltknhfkelnlnyh qlklenlavnvqeadaklnpinqtlpmvlpvkvypatafgevqyqetpirtvyireeqtkalkmg nfkalvkdrringlfsfikeendtqkhpisqlrlrreleiyqslrydafketlnleekllkkhtslssven kfrilleewkkeyaassmvtdehiafiasvrnafchnqypfyeealhapiplftvaqqtteekdglg iaeeallrvlreyceivksqi |
| *Sinomicrobium oceani* | WP_ 072319476.1 (SEQ ID NO: 119) | mesttttlglhlkyqhdlfedkhyfgggvnlavqniesifqafaerygiqnplrkngvpainnifhd nisisnykeylkflkqylpvvgfleksneinifefredfeilinaiyklrhfythyyhspikledrfytc lnelfvavaiqvkkhkmksdktrqllnknlhqllqqlieqkrekllkdkkaegekvsldtksienav lndafvhlldkdeniriynyssrlsediitkngitlsisgllfllslfqrkeaaedlrsriegfkgkgnelrf mathwvfsylnykrikhrintdfqketlliqiadelskvpdevyktldhenrskfledineyiregn edaslnestvvhgvirkryenkfhylvlryldefvdfpslrfqvhlgnyihdrrdkvidgtnfitnrvi kepikvfgklshvsklksdymeslsrehkngwdvfpnpsynfvghnipifinlrsasskgkelyr dlmkiksekkkksreegipmerrdgkptkieisnqidrnikdnnflcdiypgeplamlslnelpall fellrrpsitpqdiedrmveklyerfqiirdykpgdglstskiskklrkadnstrldgkllraiqtetrn areklhtleenkalqknrkrrtvyttreqgreaswlaqdlkrfmpiasrkewrgyhhsqlqqilafy dqnpkqplelleqfwdlkedtyvwnswihlslsqhngfvpmyegylkgrlgyykklesdiigfl eehkvlkryytqqhlnvifrerlyfiktetkqklellarplvfprgifddkptfvqdkkvvdhpelfa dwyvysykddhsfqefyhykrdyneifetelswdidfkdnkrqlnpseqmdlfrmkwdlkik kikiqdiflkivaaediylkifghkiplslsdfyisrqerltldeqavaqsmrlpgdtsenqikesnlwq ttvpyekeqirepkiklkdigkfkyflqqqkvinllkydpqhvwtkaeleeelyigkhsyevvrre mllqkchqlekhileqfrfdgsnhprelqgnhpnfkmyivngiltkrgeleieaenwwlelgns knsldkvevelltmktipeqkafllilirnkfahnqlpadnyfhyasnlmnlkksdtyslfwftvad tivqefmsl |
| *Reichenbachiella agariperforans* | WP_ 073124441.1 (SEQ ID NO: 120) | mktnpliassgekpnykkfntesdksfkkifqnkgsiapiaekacknfeikskspvnrdgrlhyfs vghafknidsknyfryeldesqmdmkptqflalqkeffdfqgalngllkhirnvnshyvhtfekl eiqsinqklitflieafelavihsylneeeelsyeaykddpqsgqklvqflcdkfypnkeheveerkti laknkrqalehllfievtsdidwklfekhkvftisngkylsfhaclfllslflykseanqleiskikgfkr nddnqyrskrqiftffskkftsqdvnseeqhlvkfrdviqylnhypsawnkhlelksgypqmtdk lmryiveaeiyrsfpdqtdnhrfllfairneffgqscldtwtgntpinfsnqeqkgfsyeintsaeikdi etklkalvlkgpinfkekkeqnfleekdkrekkeqptnrvkeklltriqhnmlyvsygrnqdrfmd |

TABLE 6-continued

```
faarflaetdyfgkdakfkmyqfytsdeqrdhlkeqkkelpkkefeklkyhqsklvdyftyaeqq
arypdwdtpfvvennaiqikvtlfngakkivsvqrnlmlylledalysekrenagkglisgyfvhh
qkelkdqldileketeisreqkrefkkllpkrilhryspaqindttewnpmevileeakaqeqryqll
lekailhqteedfikrnkgkqfklrfvrkawhlmylkelymnkvaehghhksfhitkeefndfcr
wmfafdevpkykeylcdyfsqkgffnnaeflcdliessts1ndlyektkqrfegwskdltkqsden
kyllanyesmlkddmlyvnishfisyleskgkinrnahghiaykalnnvphlieeyyykdrlape
eykshgklynklktvkledallyemamhylslepalvpkvktkvkdilssniafdikdaaghhly
hllipfhkidsfvalinhqsqqekdpdktsflakiqpylekvknskdlkavyhyykdtphtlryedl
nmihshivsqsvqftkvalkleeyfiakksitlqiarqisyseiadlsnyftdevrntafhfdvpetay
smilqgieseflcreikpqkpkslselstqqvsvctafletlhnnlfdrkddkkerlskareryfeqin
```

The following Cas13c orthologues were codon optimized for expression in mammalian cells.

TABLE 7

| | | |
|---|---|---|
| *Fusobacterium necrophorum* subsp. *funduliforme* ATCC 51357 contig00003 | (SEQ ID NO: 121) | MEKFRRQNRNSIIKIIISNYDTKGIKELKVRYRKQAQLDTFIIKTEIVNN DIFIKSIIEKAREKYRYSFLFDGEEKYHFKNKSSVEIVKKDIFSQTPDNM IRNYKITLKISEKNPRVVEAEIEDLMNSTILKDGRRSARREKSMTERKL IEEKVAKNYSLLANCPMEEVDSIKIYKIKRFLTYRSNMLLYFASINSFL CEGIKGKDNETEEIWHLKDNDVRKEKVRENFKNKLIQSTENYNSSLK NQIEEKEKLLRKEFKKGAFYRTIIKKLQQERIKELSEKSLTEDCEKIIKL YSKLRHSLMHYDYQYFENLFENKKNDDLMKDLNLDLFKSLPLIRKM KLNNKVNYLEDGDTLFVLQKTKKAKTLYQIYDALCEQKNGFNKFIND FFVSDGEENTVFKQIIINEKFQSEMEFLEKRISESEKKNEKLKKKLDSMK AHFRNINSEDTKEAYFWDIHSSRNYKTKYNERKNLVNEYTELLGSSK EKKLLREEITKINRQLLKLKQEMEEITKKNSLFRLEYKMKIAFGFLFCE FDGNISKFKDEFDASNQEKIIQYHKNGEKYLTSFLKEEEKEKFNLEKM QKIIQKTEEEDWLLPETKNNLFKFYLLTYLLLPYELKGDFLGFVKKHY YDIKNVDFIDENQNNIQVSQTVEKQEDYFYHKIRLFEKNTKKYEIVKY SIVPNEKLKQYFEDLGIDIKYLTVEQKSEVSEEKNKKVSLKNNGMFNK TILLFVFKYYQIAFKLFNDIELYSLFFLREKSGKPLEIFRKELESKMKDG YLNFGQLLYVVYEVLVKNKDLDKILSKKIDYRKDKSFSPEIAYLRNFL SHLNYSKFLDNFMKINTNKSDENKEVLIPSIKIQKMIQFIEKCNLQNQI DFDFNFVNDFYMRKEKMFFIQLKQIFPDINSTEKQKMNEKEEILRNRY HLTDKKNEQIKDEHEAQSQLYEKILSLQKIYSSDKNNFYGRLKEEKLL FLEKQGKKKLSMEEIKDKIAGDISDLLGILKKEITRDIKDKLTEKFRYC EEKLLNLSFYNHQDKKKEESIRVFLIRDKNSDNFKFESILDDGSNKIFIS KNGKEITIQCCDKVLETLIIEKNTLKISSNGKIISLIPHYSYSIDVKY |
| *Fusobacterium necrophorum* DJ-2 contig0065, whole genome shotgun sequence | (SEQ ID NO: 122) | MEKFRRQNRSSIIKIIISNYDTKGIKELKVRYRKQAQLDTFIIKTEIVNN DIFIKSIIEKAREKYRYSFLFDGEEKYHFKNKSSVEIVKKDIFSQTPDNM IRNYKITLKISEKNPRVVEAEIEDLMNSTILKDGRRSARREKSMTERKL IEEKVAENYSLLANCPMEEVDSIKIYKIKRFLTYRSNMLLYFASINSFL CEGIKGKDNETEEIWHLKDNDVRKEKVKENFKNKLIQSTENYNSSLK NQIEEKEKLLRKESKKGAFYRTIIKKLQQERIKELSEKSLTEDCEKIIKL YSELRHPLMHYDYQYFENLFENKENSELTKNLNLDIFKSLPLVRKMK LNNKVNYLEDNDTLFVLQKTKKAKTLYQIYDALCEQKNGFNKFINDF FVSDGEENTVFKQIIINEKFQSEIEFLEKRISESEKKNEKLKKKLDSMKA HFRNINSEDTKEAYFWDIHSSRNYKTKYNERKNLVNEYTELLGSSKE KKLLREEITKINRQLLKLKQEMEEITKKNSLFRLEYKMKMAFGFLFCE FDGNISRFKDEFDASNQEKIIQYHKNGEKYLTYFLKEEEKEKFNLKKL QETIQKTGEENWLLPQNKNNLFKFYLLTYLLLPYELKGDFLGFVKKH YYDIKNVDFMDENQSSKITESKEDDFYHKIRLFEKNTKKYEIVKYSIVP DKKLKQYFKDLGIDTKYLILDQKSEVSGEKNKKVSLKNNGMFNKTIL LFVFKYYQIAFKLFNDIELYSLFFLREKSGKPFEVFLKELKDKMIGKQL NFGQLLYVVYEVLVKNKDLSEILSERIDYRKDMCFSAEIADLRNFLSH LNYSKFLDNFMKINTNKSDENKEVLIPSIKIQKMIKFIEECNLQSQIDFD FNFVNDFYMRKEKMFFIQLKQIFPDINSTEKQKMNEKEEILRNRYHLT DKKNEQIKDEHEAQSQLYEKILSLQKIYSSDKNNFYGRLKEEKLLFLE KQEKKKLSMEEIKDKIAGDISDLLGILKKEITRDIKDKLTEKFRYCEEK LLNLSFYNHQDKKKEESIRVFLIRDKNSDNFKFESILDDGSNKIFISKNG KEITIQCCDKVLETLIIEKNTLKISSNGKIISLIPHYSYSIDVKY |
| *Fusobacterium necrophorum* BFTR-1 contig0068 | (SEQ ID NO: 123) | MKVRYRKQAQLDTFIIKTEIVNNDIFIKSIIEKAREKYRYSFLFDGEEKY HFKNKSSVEIVKNDIFSQTPDNMIRNYKITLKISEKNPRVVEAEIEDLM NSTILKDGRRSARREKSMTERKLIEEKVAENYSLLANCPIEEVDSIKIY KIKRFLTYRSNMLLYFASINSFLCEGIKGKDNETEEIWHLKDNDVRKE KVKENFKNKLIQSTENYNSSLKNQIEEKEKLSSKEFKKGAFYRTIIKKL QQERIKELSEKSLTEDCEKIIKLYSELRHPLMHYDYQYFENLFENKENS ELTKNLNLDIFKSLPLVRKMKLNNKVNYLEDNDTLFVLQKTKKAKTL YQIYDALCEQKNGFNKFINDFFVSDGEENTVFKQIIINEKFQSEMEFLEK RISESEKKNEKLKKKLDSMKAHFRNINSEDTKEAYFWDIHSSRNYKTK YNERKNLVNEYTKLLGSSKEKKLLREEITKINRQLLKLKQEMEEITKK NSLFRLEYKMKIAFGFLFCEFDGNISKFKDEFDASNQEKIIQYHKNGEK YLTSFLKEEEKEKFNLEKMQKIIQKTEEEDWLLPETKNNLFKFYLLTY LLLPYELKGDFLGFVKKHYYDIKNVDFMDENQNNIQVSQTVEKQEDY |

TABLE 7-continued

| | | |
|---|---|---|
| | | FYHKIRLFEKNTKKYEIVKYSIVPNEKLKQYFEDLGIDIKYLTGSVESG<br>EKWLGENLGIDIKYLTVEQKSEVSEEKNKKVSLKNNGMFNKTILLLFVF<br>KYYQIAFKLFNDIELYSLFFLREKSEKPFEVFLEELKDKMIGKQLNFGQ<br>LLYVVYEVLVKNKDLDKILSKKIDYRKDKSFSPEIAYLRNFLSHLNYS<br>KFLDNFMKINTNKSDENKEVLIPSIKIQKMIQFIEKCNLQNQIDFDFNFV<br>NDFYMRKEKMFFIQLKQIFPDINSTEKQKKSEKEEILRKRYHLINKKNE<br>QIKDEHEAQSQLYEKILSLQKIFSCDKNNFYRRLKEEKLLFLEKQGKK<br>KISMKEIKDKIASDISDLLGILKKEITRDIKDKLTEKFRYCEEKLLNISFY<br>NHQDKKKEEGIRVFLIRDKNSDNFKFESILDDGSNKIFISKNGKEITIQC<br>CDKVLETLMIEKNTLKISSNGKIISLIPHYSYSIDVKY |
| Fusobacterium<br>necrophorum<br>subsp.<br>funduliforme<br>1_1_36S<br>cont1.14 | (SEQ<br>ID NO:<br>124) | MTEKKSIIFKNKSSVEIVKKDIFSQTPDNMIRNYKITLKISEKNPRVVEA<br>EIEDLMNSTILKDGRRSARREKSMTERKLIEEKVAENYSLLANCPMEE<br>VDSIKIYKIKRFLTYRSNMLLYFASINSFLCEGIKGKDNETEEIWHLKD<br>NDVRKEKVKENFKNKLIQSTENYNSSLKNQIEEKEKLLRKESKKGAF<br>YRTIIKKLQQERIKELSEKSLTEDCEKIIKLYSELRHPLMHYDYQYFEN<br>LFENKENSELTKNLNLDIFKSLPLVRKMKLNNKVNYLEDNDTLFVLQ<br>KTKKAKTLYQIYDALCEQKNGFNKFINDFFVSDGEENTVFKQIIINEKF<br>QSEMEFLEKRISESEKKNEKLKKKFDSMKAHFHNINSEDTKEAYFWDI<br>HSSSNYKTKYNERKNLVNEYTELLGSSKEKKLLREEITQINRKLLKLK<br>QEMEEITKKNSLFRLEYKMKIAFGFLFCEFDGNISKFKDEFDASNQEKI<br>IQYHKNGEKYLTYFLKEEEKEKFNLEKMQKIIQKTEEEDWLLPETKNN<br>LFKFYLLTYLLLPYELKGDFLGFVKKHYYDIKNVDFMDENQNNIQVS<br>QTVEKQEDYFYHKIRLFEKNTKKYEIVKYSIVPNEKLKQYFEDLGIDIK<br>YLTGSVESGEKWLGENLGIDIKYLTVEQKSEVSEEKIKKFL |
| Fusobacterium<br>perfoetens<br>ATCC 29250<br>T364DRAFT_<br>scaffold00009.9_<br>C | (SEQ<br>ID NO:<br>125) | MGKPNRSSIIKIIISNYDNKGIKEVKVRYNKQAQLDTFLIKSELKDGKFI<br>LYSIVDKAREKYRYSFEIDKTNINKNEILIIKKDIYSNKEDKVIRKYILSF<br>EVSEKNDRTIVTKIKDCLETQKKEKFERENTRRLISETERKLLSEETQK<br>TYSKIACCSPEDIDSVKIYKIKRYLAYRSNMLLFFSLINDIFVKGVVKD<br>NGEEVGEIWRIIDSKEIDEKKTYDLLVENFKKRMSQEFINYKQSIENKI<br>EKNTNKIKEIEQKLKKEKYKKEINRLKKQLIELNRENDLLEKDKIELSD<br>EEIREDIEKILKIYSDLRHKLMHYNYQYFENLFENKKISKEKNEDVNLT<br>ELLDLNLFRYLPLVRQLKLENKTNYLEKEDKITVLGVSDSAIKYYSYY<br>NFLCEQKNGFNNFINSFFSNDGEENKSFKEKINLSLEKEIEIMEKETNE<br>KIKEINKNELQLMKEQKELGTAYVLDIHSLNDYKISHNERNKNVKLQ<br>NDIMNGNRDKNALDKINKKLVELKIKMDKITKRNSILRLKYKLQVAY<br>GFLMEEYKGNIKKFKDEFDISKEKIKSYKSKGEKYLEVKSEKKYITKIL<br>NSIEDIHNITWLKNQEENNLFKFYVLTYILLPFEFRGDFLGFVKKHYYD<br>IKNVEFLDENNDRLTPEQLEKMKNDSFFNKIRLFEKNSKKYDILKESIL<br>TSERIGKYFSLLNTGAKYFEYGGEENRGIFNKNIIIPIFKYYQIVLKLYN<br>DVELAMLLTLSESDEKDINKIKELVTLKEKVSPKKIDYEKKYKFSVLL<br>DCFNRIIINLGKKDFLASEEVKEVAKTFTNLAYLRNKICHLNYSKFIDDL<br>LTIDTNKSTTDSEGKLLINDRIRKLIKFIRENNQKMNISIDYNYINDYYM<br>KKEKFIFGQRKQAKTIIDSGKKANKRNKAEEELLKMYRVKKENINLIYE<br>LSKKLNELTKSELFLLDKKLLKDIDFTDVKIKNKSFFELKNDVKEVANI<br>KQALQKHSSELIGIYKKEVIMAIKRSIVSKLIYDEEKVLSIIIYDKTNKK<br>YEDFLLEIRRERDINKFQFLIDEKKEKLGYEKIIETKEKKKVVVKIQNN<br>SELVSEPRIIKNKDKKKAKTPEEISKLGILDLTNHYCFNLKITL |
| Fusobacterium<br>ulcerans ATCC<br>49185 cont2.38 | (SEQ<br>ID NO:<br>126) | MENKGNNKKIDFDENYNILVAQIKEYFTKEIENYNNRIDNIIDKKELLK<br>YSEKKEESEKNKKLEELNLKSQKLKILTDEEIKADVIKIIKIFSDLRHS<br>LMHYEYKYFENLFENKKNEELAELLNLNLFKNLTLLRQMKIENKTNY<br>LEGREEFNIIGKNIKAKEVLGHYNLLAEQKNGFNNFINSPFVQDGTEN<br>LEFKKLIDEHFVNAKKRLERNIKKSKKLEKELELMEQHYQRLNCAYV<br>WDIHTSTTYKKLYNKRKSLIEEYNKQINEIKDKEVITAINVELLRIKKE<br>MEEITKSNSLFRLYKMQIAYAFLEIEFGGNIAKFKDEFDCSKMEEVQ<br>KYLKKGVKYLKYYKDKEAQKNYEFPPFEEIFENKDTHNEEWLENTSEN<br>NLFKFYILTYLLLPMEFKGDFLGVVKKHYYDIKNVDFTDESEKELSQV<br>QLDKMIGDSFFHKIRLFEKNTKRYEIIKYSILTSDEIKRYFRLLELDVPY<br>FEYEKGTDEIGIFNKNIILTIFKYYQIIFRLYNDLEIHGLFNISSDLDKILR<br>DLKSYGNKNINFREFLYVIKQNNNSSTEEEYRKIWENLEAKYLRLHLL<br>TPEKEEIKTKTKEELEKLNEISNLRNGICHLNYKEIIEEILKTEISEKNKE<br>ATLNEKIRKVINFIKENELDKVELGFNFINDFFMKKEQFMFGQIKQVK<br>EGNSDSITTERERKEKNNKKLKETYELNCDNLSEFYETSNNLRERANS<br>SSLLEDSAFLKKIGLYKVKNNKVNSKVKDEEKRIENIKRKLLKDSSDI<br>MGMYKAEVVKKLKEKLILIFKHDEEKRIYVTVYDTSKAVPENISKEIL<br>VKRNNSKEEYFFEDNNKKYVTEYYTLEITETNELKVIPAKKLEGKEFK<br>TEKNKENKLMLNNHYCFNVKIIY |
| Anaerosalibacter<br>sp. ND1 genome<br>assembly<br>Anaerosalibacter<br>massiliensis<br>ND1 | (SEQ<br>ID NO:<br>127) | MKSGRREKAKSNKSSIVRVIISNFDDKQVKEIKVLYTKQGGIDVIKFKS<br>TEKDEKGRMKFNFDCAYNRLEEEEFNSFGGKGKQSFFVTTNEDLTEL<br>HVTKRHKTTGEIIKDYTIQGKYTPIKQDRTKVTVSITDNKDHFDSNDL<br>GDKIRLSRSLTQYTNRILLDADVMKNYREIVCSDSEKVDETINIDSQEI<br>YKINRFLSYRSNMIIYYQMINNFLLHYDGEEDKGGNDSINLINEIWKYE<br>NKKNDEKEKIIERSYKSIEKSINQYILNHNTEVESGDKEKKIDISEERIK<br>EDLKKTFILFSRLRHYMVHYNYKFYENLYSGKNFIIYNKDKSKSRRFS<br>ELLLDNIFKELSKIKLVKNRAVSNYLDKKTTIHVLNKNINAIKLLDIYR<br>DICETKNGFNNFINNMMTISGEEDKEYKEMVTKHFNENMNKLSTYLE<br>NFKKHSDFKTNNKKKETYNLLKQELDEQKKLRLWFNAPYVYDIHSS |

TABLE 7-continued

```
KKYKELYVERKKYVDIHSKLIEAGINNDNKKKLNEINVKLCELNTEM
KEMTKLNSKYRLQYKLQLAFGFILEEFNLDIDKFVSAFDKDNNLTISK
FMEKRETYLSKSLDRRDNRFKKLIKDYKFRDTEDIFCSDRENNLVKLY
ILMYILLPVEIRGDFLGFVKKNYYDLKHVDFIDKRNNDNKDTFFHDLR
LFEKNVKRLEVTSYSLSDGFLGKKSREKFGKELEKFIYKNVSIALPTNI
DIKEFNKSLVLPMMKNYQIIFKLLNDIEISALFLIAKKEGNEGSITFKKV
IDKVRKEDMNGNINFSQVMKMALNEKVNCQIRNSIAHINMKQLYIEP
LNIYINNNQNKKTISEQMEEIIDICITKGLTGKELNKNIINDYYMKKEKL
VFNLKLRKRNNLVSIDAQQKNMKEKSILNKYDLNYKDENLNIKEIILK
VNDLNNKQKLLKETTEGESNYKNALSKDILLLNGIIRKNINFKIKEMIL
GIIQQNEYRYVNINIYDKIRKEDHNIDLKINNKYIEISCYENKSNESTDE
RINFKIKYMDLKVKNELLVPSCYEDIYIKKKIDLEIRYIENCKVVYIDIY
YKKYNINLEFDGKTLFVKFNKDVKKNNQKVNLESNYIQNIKFIVS
```

The protein sequences of the C2c2 (Cas13a) species are listed in Table 8 below.

TABLE 8

| | | | |
|---|---|---|---|
| c2c2-5 | 1 | Lachno-<br>spiraceae<br>bacterium<br>MA2020<br>(SEQ ID<br>NO: 128) | MQISKVNHKHVAVGQKDRERITGFIYNDPVGDEKSLEDVVAKRANDTKV<br>LENVENTKDLDYSQESDKSEKDKEIISKGAKEVAKSENSAITILKKQNKIYS<br>TLTSQQVIKELKDKEGGARIYDDDIEEALTETLKKSFRKENVRNSIKVLIEN<br>AAGIRSSLSKDEEELIQEYFVKQLVEEYTKTKLQKNVVKSIKNQNMVIQPD<br>SDSQVLSLSESRREKQSSAVSSDTLVNCKEKDVLKAFLTDYAVLDEDERNS<br>LLWKLRNLVNLYFYGSESIRDYSYTKEKSVWKEHDEQKANKTLFIDEICHI<br>TKIGKNGKEQKVLDYEENRSRCRKQNINYYRSALNYAKNNTSGIFENEDS<br>NHEWIHLIENEVERLYNGIENGEEFKFETGYISEKVWKAVINHLSIKYIALG<br>KAVYNYAMKELSSPGDIEPGKIDDSYINGITSFDYEIIKAEESLQRDISMNV<br>VFATNYLACATVDTDKDELLFSKEDIRSCTKKDGNLCKNIMQFWGGYST<br>WKNECEEYLKDDKDALELLYSLKSMLYSMRNSSFHESTENVDNGSWDTE<br>LIGKLFEEDCNRAARIEKEKEYNNNLHMFYSSSLLEKVLERLYSSHHERAS<br>QVPSENRVEVRKNEPSSLSEQRITPKFTDSKDEQIWQSAVYYLCKEIYYND<br>FLQSKEAYKLFREGVKNLDKNDINNQKAADSFKQAVVYYGKAIGNATLSQ<br>VCQAIMTEYNRQNNDGLKKKSAYAEKQNSNKYKHYPLELKQVLQSAFWE<br>YLDENKEIYGFISAQIHKSNVEIKAEDFIANYSSQQYKKLVDKVKKTPELQK<br>WYTLGRLINPRQANQFLGSIRNYVQFVKDIQRRAKENGNPIRNYYEVLES<br>DSIIKILEMCTKLNGTTSNDIHDYFRDEDEYAEYISQFVNEGDVHSGAALN<br>AFCNSESEGKKNGIYYDGINPIVNRNWVLCKLYGSPDLISKIISRVNENMIH<br>DFFIKQEDLIREYQIKGICSNKKEQQDLRTFQVLKNRVELRDIVEYSEIINEL<br>YGQLIKWCYLRERDLMYFQLGEHYLCLNNASSKEADYIKINVDDRNISGAI<br>LYQIAAMYINGLPVYYKKDDMYVALKSGKKASDELNSNEQTSKKINYFLK<br>YGNNILGDKKDQLYLAGLELFENVAEHENIIIERNEIDHEHYFYDRDRSML<br>DLYSEVEDREFTYDMKLRKNVVNMLYNILLDHNIVSSFVFETGEKKVGRG<br>DSEVIKPSAKIRLRANNGVSSDVETYKVGSKDELKIATLPAKNEEFLLNVA<br>RLIYYPDMEAVSENMVREGVVKVEKSNDKKGKISRGSNTRSSNQSKYNNK<br>SKNRMNYSMGSIFEKMDLKFD |
| c2c2-6 | 2 | Lachno-<br>spiraceae<br>bacterium<br>NK4A179<br>(SEQ ID<br>NO: 129) | MKISKVREENRGAKLTVNAKTAVVSENRSQEGILYNDPSRYGKSRKNDED<br>RDRYIESRLKSSGKLYRIFNEDKNKRETDELQWELSEIVKKINRRNGLVLS<br>DMLSVDDRAFEKAFEKYAELSYTNRRNKVSGSPAFETCGVDAATAERLKG<br>IISETNPINRIKNNIDNKVSEDIIDRIIAKYLKKSLCRERVKRGLKKLLMNAF<br>DLPYSDPDIDVQRDFIDYVLEDFYHVRAKSQVSRSIKNMNMPVQPEGDGK<br>FAITVSKGGTESGNKRSAEKEAFKKELSDYASLDERVRDDMLRRMRRLVV<br>LYFYGSDDSKLSDVNEKFDVWEDHAARRVDNREFIKLPLENKLANGKTD<br>KDAERIRKNTVKELYRNQNIGCYRQAVKAVEEDNNGRYFDDKMLNMFFI<br>HRIEYGVEKIYANLKQVTEFKARTGYLSEKIWKDLINYISIKYIAMGKAVYN<br>YAMDELNASDKKEIELGKISEEYLSGISSFDYELIKAEEMLQRETAVYVAFA<br>ARHLSSQTVELDSENSDELLLKPKGTMDKNDKNKLASNNILNELKDKETL<br>RDTILQYFGGHSLWTDPPFDKYLAGGKDDVDFLTDLKDVIYSMRNDSFHY<br>ATENHNNGKWNKELISAMFEHETERMTVVMKDKFYSNNLPMFYKNDD<br>LKKLLIDLYKDNVERASQVPSENKVEVRKNEPALVRDKDNLGIELDLKAD<br>ADKGENELKEYNALYYMEKEIYYNAFLNDKNVRERFITKATKVADNYDR<br>NKERNLKDRIKSAGSDEKKKLREQLQNYIAENDFGQRIKNIVQVNPDYTL<br>AQICQLIMTEYNQQNNGCMQKKSAARKDINKDSYQHYKMLLLVNLRKAF<br>LEFIKENYAFVLKPYKHDLCDKADEVPDFAKYVKPYAGLISRVAGSSELQK<br>WYIVSRELSPAQANHMLGELHSYKQYVWDIYRRASETGTEINHSIAEDKIA<br>GVDITDVDAVIDLSVKLCGTISSEISDYFKDDEVYAEYISSYLDFEYDGGNYK<br>DSLNRECNSDAVNDQKVALYYDGEHPKLNRNIILSKLYGERRFLEKITDRV<br>SRSDIVEYYKLKKETSQYQTKGIFDSEDEQKNIKKFQEMKNIVEFRDLMDY<br>SEIADELQGQLINWIYLRERDLMNFQLGYHYACLNNDSNKQATYVTLDYQ<br>GKKNRKINGAILYQICAMYINGLPLYYVDKDSSEWTVSDGKESTGAKIGEF<br>YRYAKSFENTSDCYASGLEIFENISEHDNITELRNYIEHFRYYSSFDRSFLGI<br>YSEVEDREFTYDLKYRKNVPTILYNILLQHFVNVRFEFVSGKKMIGIDKKD<br>RKIAKEKECARITIREKNGVYSEQFTYKLKNGTVYVDARDKRYLQSIIRLLF<br>YPEKVNMDEMIEVKEKKKPSDNNTGKGYSKRDRQQDRKEYDKYKEKKK<br>KEGNFLSGMGGNINWDEINAQLKN |

TABLE 8-continued

| | | | |
|---|---|---|---|
| c2c2-7 | 3 | [Clostridium] aminophilum DSM 10710 (SEQ ID NO: 130) | MKESKVDHTRSAVGIQKATDSVHGMLYTDPKKQEVNDLDKREDQLNVK<br>AKRLYNVENQSKAEEDDDEKREGKVVKKLNRELKDLLEHREVSRYNSIGN<br>AKYNYYGIKSNPEEIVSNLGMVESLKGERDPQKVISKLLLYYLRKGLKPGT<br>DGLRMILEASCGLRKLSGDEKELKVFLQTLDDFEKKTFKKNLIRSIENQN<br>MAVQPSNEGDPIIGITQGRENSQKNEEKSAIERMMSMYADLNEDHREDVL<br>RKLRRLNVLYFNVDTEKTEEPTLPGEVDTNPVFEVWHDHEKGKENDRQF<br>ATFAKILTEDRETRKKEKLAVKEALNDLKSAIRDHNIMAYRCSIKVTEQDK<br>DGLFFEDQRINREWIHHIESAVERILASINPEKLYKLRIGYLGEKVWKDLL<br>NYLSIKYIAVGKAVEHFAMEDLGKTGQDIELGKLSNSVSGGLTSFDYEQIRA<br>DETLQRQLSVEVAFAANNLFRAVVGQTGKKIEQSKSEENEEDELLWKAEK<br>IAESIKKEGEGNTLKSILQFFGGASSWDLNHFCAAYGNESSALGYETKFAD<br>DLRKAIYSLRNETFHFTTLNKGSFDWNAKLIGDMFSHEAATGIAVERTRF<br>YSNNLPMFYRESDLKRIMDHLYNTYHPRASQVPSFNSVFVRKNFRLFLSN<br>TLNTNTSFDTEVYQKWESGVYYLFKEIYYNSFLPSGDAHHLFFEGLRRIRK<br>EADNLPIVGKEAKKRNAVQDFGRRCDELKNLSLSAICQMIMTEYNEQNNG<br>NRKVKSTREDKRKPDIFQHYKMLLLRTLQEAFAIYIRREEFKFIFDLPKTL<br>YVMKPVEEFLPNWKSGMFDSLVERVKQSPDLQRWYVLCKFLNGRLLNQL<br>SGVIRSYIQFAGDIQRRAKANHNRLYMDNTQRVEYYSNVLEVVDFCIKGTS<br>RFSNVFSDYFRDEDAYADYLDNYLQFKDEKIAEVSSFAALKTFCNEEEVKA<br>GIYMDGENPVMQRNIVMAKLFGPDEVLKNVVPKVTREEIEEYYQLEKQIA<br>PYRQNGYCKSEEDQKKLLRFQRIKNRVEFQTITEFSEIINELLGQLISWSFL<br>RERDLLYFQLGFHYLCLHNDTEKPAEYKEISREDGTVIRNAILHQVAAMY<br>VGGLPVYTLADKKLAAFEKGEADCKLSISKDTAGAGKKIKDFFRYSKYVLI<br>KDRMLTDQNQKYTIYLAGLELFENTDEHDNITDVRKYVDHFKYYATSDE<br>NAMSILDLYSEIHDRFFTYDMKYQKNVANMLENILLRHFVLIRPEFFTGSK<br>KVGEGKKITCKARAQIEIAENGMRSEDFTYKLSDGKKNISTCMIAARDQKY<br>LNTVARLLYYPHEAKKSIVDTREKKNNKKTNRGDGTFNKQKGTARKEKD<br>NGPREFNDTGFSNTPFAGFDPFRNS |
| c2c2-8 | 5 | Carnobacterium gallinarum DSM 4847 (SEQ ID NO: 131) | MRITKVKIKLDNKLYQVTMQKEEKYGTLKLNEESRKSTAEILRLKKASFN<br>KSFHSKTINSQKENKNATIKKNGDYISQIFEKLVGVDTNKNIRKPKMSLTD<br>LKDLPKKDLALFIKRKFKNDDIVEIKNLDLISLFYNALQKVPGEHFTDESW<br>ADFCQEMMPYREYKNKFIERKIILLANSIEQNKGFSINPETFSKRKRVLHQ<br>WAIEVQERGDFSILDEKLSKLAEIYNFKKMCKRVQDELNDLEKSMKKGKN<br>PEKEKEAYKKQKNFKIKTIWKDYPYKTHIGLIEKIKENEELNQFNIEIGYKF<br>EHYFPIKKERCTEDEPYYLNSETIATTVNYQLKNALISYLMQIGKYKQFGLE<br>NQVLDSKKLQEIGIYEGFQTKFMDACVFATSSLKNIIEPMRSGDILGKREFK<br>EAIATSSFVNYHHFFPYFPFELKGMKDRESELIPFGEQTEAKQMQNIWAL<br>RGSVQQIRNEIFHSFDKNQKFNLPQLDKSNFEFDASENSTGKSQSYIETDY<br>KPLFEAEKNQLEQFFIERIKSSGALEYYPLKSLEKLFAKKEMKFSLGSQVVA<br>FAPSYKKLVKKGHSYQTATEGTANYLGLSYYNRYELKEESFQAQYYLLKLI<br>YQYVFLPNFSQGNSPAFRETVKAILRINKDEARKMKKNKKFLRKYAFEQ<br>VREMEFKETPDQYMSYLQSEMREEKVRKAEKNDKGFEKNITMNFEKLL<br>MQIFVKGFDVFLTTFAGKELLLSSEEKVIKETEISLSKKINEREKTLKASIQV<br>EHQLVATNSAISYWLFCKLLDSRHLNELRNEMIKFKQSRIKFNHTQAELI<br>QNLLPIVELTILSNDYDEKNDSQNVDVSAYFEDKSLYETAPYVQTDDRTR<br>VSFRPILKLEKYHTKSLIEALLKDNPQFRVAATDIQEWMHKREEIGELVEK<br>RKNLHTEWAEGQQTLGAEKREEYRDYCKKIDRFNWKANKVTLTYLSQL<br>HYLITDLLGRMVGFSALFERDLVYFSRSFSELGGETYHISDYKNLSGVLRLN<br>AEVKPIKIKNIKVIDNEENPYKGNEPEVKPFLDRLHAYLENVIGIKAVHGKI<br>RNQTAHLSVLQLELSMIESMNNLRDLMAYDRKLKNAVTKSMIKILDKHG<br>MILKLKIDENHKNFEIESLIPKEIIHLKDKAIKTNQVSEEYCQLVLALLTTNP<br>GNQLN |
| c2c2-9 | 6 | Carnobacterium gallinarum DSM 4847 (SEQ ID NO: 132) | MRMTKVKINGSPVSMNRSKLNGHLVWNGTTNTVNILTKKEQSFAASFLN<br>KTLVKADQVKGYKVLAENIFIIFEQLEKSNSEKPSVYLNNIRRLKEAGLKRF<br>FKSKYHEEIKYTSEKNQSVPTKLNLIPLFFNAVDRIQEDKFDEKNWSYFCK<br>EMSPYLDYKKSYLNRKKEILANSIQQNRGFSMPTAEEPNLLSKRKQLFQQ<br>WAMKFQESPLIQQNNFAVEQFNKEFANKINELAAVYNVDELCTAITEKL<br>MNFDKDKSNKTRNFEIKKLWKQHPHNKDKALIKLFNQEGNEALNQFNIE<br>LGKYFEHYFPKTGKKESAESYYLNPQTIIKTVGYQLRNAFVQYLLQVGKLH<br>QYNKGVLDSQTLQEIGMYEGFQTKFMDACVFASSSLRNIIQATTNEDILTR<br>EKFKKELEKNVELKHDLFFKTEIVEERDENPAKKIAMTPNELDLWAIRGA<br>VQRVRNQIFHQQINKRHEPNQLKVGSFENGDLGNVSYQKTIYQKLFDAEI<br>KDIEIYFAEKIKSSGALEQYSMKDLEKLFSNKELTLSLGGQVVAFAPSYKKL<br>YKQGYFYQNEKTIELEQFTDYDFSNDVFKANYYLIKLIYHYVFLPQFSQAN<br>NKLFKDTVHYVIQQNKELNTTEKDKKNNKKIRKYAFEQVKLMKNESPEK<br>YMQYLQREMQEERTIKEAKKTNEEKPNYNFEKLLIQIFIKGFDTFLRNFDL<br>NLNPAEELVGTVKEKAEGLRRKERIAKILNVDEQIKTGDEEIAFWIFAKL<br>LDARHLSELRNEMIKFKQSSVVKKGLIKNGDLIEQMQPILELCILSNDSESME<br>KESFDKIEVFLEKVELAKNEPYMQEDKLTPVKFRFMKQLEKYQTRNFIEN<br>LVIENPEFKVSEKIVLNWHEEKEKIADLVDKRTKLHEEWASKAREIEEYN<br>EKIKKNKSKKLDKPAEFAKFAEYKIICEAIENFNRLDHKVRLTYLKNLHYL<br>MIDLMGRMVGFSVLFERDFVYMGRSYSALKKQSIYLNDYDTFANIRDWEV<br>NENKHLFGTSSSDLTFQETAEFKNLKKPMENQLKALLGVTNHSFEIRNNI<br>AHLHVLRNDGKGEGVSLLSCMNDLRKLMSYDRKLKNAVTKAIIKILDKHG<br>MILKLTNNDHTKPFEIESLPKPKKIIHLEKSNHSFPMDQVSQEYCDLVKKML<br>VFTN |

TABLE 8-continued

| c2c2-10 | 7 | Paludibacter propionicigenes WB4 (SEQ ID NO: 133) | MRVSKVKVKDGGKDKMVLVHRKTTGAQLVYSGQPVSNETSNILPEKKRQ SFDLSTLNKTIIKFDTAKKQKLNVDQYKIVEKIFKYPKQELPKQIKAEEILP FLNHKFQEPVKYWKNGKEESFNLTLLIVEAVQAQDKRKLQPYYDWKTW YIQTKSDLLKKSIENNRIDLTENLSKRKKALLAWETEFTASGSIDLTHYHK VYMTDVLCKMLQDVKPLTDDKGKINTNAYHRGLKKALQNHQPAIFGTRE VPNEANRADNQLSIYHLEVVKYLEHYFPIKTSKRRNTADDIAHYLKAQTL KTTIEKQLVNAIRANIIQQGKTNHHELKADTTSNDLIRIKTNEAFVLNLTG TCAFAANNIRNMVDNEQTNDILGKGDFIKSLLKDNTNSQLYSFFFGEGLST NKAEKETQLWGIRGAVQQIRNNVNHYKKDALKTVFNISNFENPTITDPKQ QTNYADTIYKARFINELEKIPEAFAQQLKTGGAVSYYTIENLKSLLTTFQFS LCRSTIPFAPGFKKVFNGGINYQNAKQDESFYELMLEQYLRKENFAEESYN ARYFMLKLIYNNLFLPGFTTDRKAFADSVGFVQMQNKKQAEKVNPRKKE AYAFEAVRPMTAADSIADYMAYVQSELMQEQNKKEEKVAEETRINFEKF VLQVFIKGFDSFLRAKEFDFVQMPQPQLTATASNQQKADKLNQLEASITA DCKLTPQYAKADDATHIAFYVFCKLLDAAHLSNLRNELIKFRESVNEFKF HHLLEIIEICLLSADVVPTDYRDLYSSEADCLARLRPFIEQGADITNWSDLF VQSDKHSPVIHANIELSVKYGTTKLLEQIINKDTQFKTTEANFTAWNTAQ KSIEQLIKQREDHHEQWVKAKNADDKEKQERKREKSNFAQKFIEKHGDD YLDICDYINTYNWLDNKMHFVHLNRLHGLTIELLGRMAGFVALFDRDFQ FFDEQQIADEFKLHGFVNLHSIDKKLNEVPTKKIKEIYDIRNKIIQINGNKIN ESVRANLIQFISSKRNYYNNAFLHVSNDEIKEKQMYDIRNHIAHFNYLTKD AADFSLIDLINELRELLHYDRKLKNAVSKAFIDLFDKHGMILKLKLNADHK LKVESLEPKKIYHLGSSAKDKPEYQYCTNQVMMAYCNMCRSLLEMKK |
| c2c2-11 | 9 | Listeria weihenstephanensis FSL R9-0317 (SEQ ID NO: 134) | MLALLHQEVPSQKLHNLKSLNTESLTKLEKPKFQNMISYPPSKGAEHVQF CLTDIAVPAIRDLDEIKPDWGIFFEKLKPYTDWAESYIHYKQTTIQKSIEQN KIQSPDSPRKLVLQKYVTAFLNGEPLGLDLVAKKYKLADLAESEKVVDLNE DKSANYKIKACLQQHQRNILDELKEDPELNQYGIEVKKYIQRYFPIKRAPN RSKHARADFLKKELIESTVEQQFKNAVYHYVLEQGKMEAYELTDPKTKDL QDIRSGEAFSFKFINACAFASNNLKMILNPECEKDILGKGDFKKNLPNSTT QSDVVKKMIPFFSDEIQNVNEDEAIWAIRGSIQQIRNEVYHCKKHSWKSIL KIKGFEFEPNNMKYTDSDMQKLMDKDIAKIPDFIEEKLKSSGIIREYSHDK LQSIWEMKQGFSLLTTNAPFVPSFKRVYAKGHDYQTSKNRYYDLGLTTED ILEYGEEDFRARYFLTKLVYYQQEMPWFTADNNAFRDAANFVLRLNKNR QQDAKAFINIREVEEGEMPRDYMGYVQGQIAIHEDSTEDTPNHFEKFISQV FIKGEDSHMRSADLKFIKNPRNQGLEQSEIEEMSFDIKVEPSFLKNKDDYI AFWTFCKMLDARHLSELRNEMIKYDGHLTGEQEIIGLALLGVDSRENDW KQFFSSEREYEKIMKGYVGEELYQREPYRQSDGKTPILFRGVEQARKYGTE TVIQRLFDASPEEKVSKCNITEWERQKETIEETIERRKELHNEWEKNPKK PQNNAFFKEYKECCDAIDAYNWHKNKTTLVYVNELHHLLIEILGRYVGYV AIADRDEQCMANQYFKHSGITERVEYWGDNRLKSIKKLDTFLKKEGLEVS EKNARNHIAHLNYLSLKSECTLLYLSERLREIFKYDRKLKNAVSKSLIDILD RHGMSVVFANLKENKHRLVIKSLEPKKLRHLGEKKIDNGYIETNQVSEEY CGIVKRLLEI |
| c2c2-12 | 10 | Listeriaceae bacterium FSL M6-0635 = Listeria newyorkensis FSL M6-0635 (SEQ ID NO: 135) | MKITKMRVDGRTIVMERTSKEGQLGYEGIDGNKTTEIIFDKKKESFYKSIL NKTVRKPDEKEKNRRKQAINKAINKEITELMLAVLHQEVPSQKLHNLKSL NTESLTKLEKPKFQNMISYPPSKGAEHVQFCLTDIAVPAIRDLDEIKPDWG IFFEKLKPYTDWAESYIHYKQTTIQKSIEQNKIQSPDSPRKLVLQKYVTAFL NGEPLGLDLVAKKYKLADLAESFKLVDLNEDKSANYKIKACLQQHQRNIL DELKEDPELNQYGIEVKKYIQRYFPIKRAPNRSKHARADFLKKELIESTVE QQFKNAVYHYVLEQGKMEAYELTDPKTKDLQDIRSGEAFSFKFINACAFA SNNLKMILNPECEKDILGKGNEKKNLPNSTTRSDVVKKMIPFFSDEIQNV NEDEAIWAIRGSIQQIRNEVYHCKKHSWKSILKIKGFEFEPNNMKYADSD MQKLMDKDIAKIPEFIEEKLKSSGVVREYRHDELQSIWEMKQGFSLLTTN APFVPSFKRVYAKGHDYQTSKNRYYNLDLTTEDILEYGEEDFRARYFLTKL VYYQQEMPWFTADNNAFRDAANFVLRLNKNRQQDAKAFINIREVEEGE MPRDYMGYVQGQIAIHEDSIEDTPNHFEKFISQVFIKGFDRHMRSANLKFI KNPRNQGLEQSEIEEMSFDIKVEPSFLKNKDDYIAFWIFCKMLDARHLSEL RNEMIKYDGHLTGEQEIIGLALLGVDSRENDWKQFFSSEREYEKIMKGYV VEELYQREPYRQSDGKTPILFRGVEQARKYGTETVIQRLFDANPEEKVSKC NLAEWERQKETIEETIKRRKELHNEWAKNPKKPQNNAFFKEYKECCDAI DAYNWHKNKTTLAYVNELHHLLIEILGRYVGYVAIADRDFQCMANQYFK HSGITERVEYWGDNRLKSIKKLDTFLKKEGLEVSEKNARNHIAHLNYLSLK SECTLLYLSERLREIFKYDRKLKNAVSKSLIDILDRHGMSVVFANLKENKH RLVIKSLEPKKLRHLGGKKIDGGYIETNQVSEEYCGIVKRLLEM |
| c2c2-13 | 12 | Leptotrichia wadei F0279 (SEQ ID NO: 136) | MKVTKVDGISHKKYIEEGKLVKSTSEENRTSERLSELLSIRLDIYIKNPDNA SEEENRIRRENLKKFFSNKVLHLKDSVLYLKNRKEKNAVQDKNYSEEDISE YDLKNKNSFSVLKKILLNEDVNSEELEIFRKDVEAKLNKINSLKYSPEENK ANYQKINENNVEKVGGKSKRNIIYDYYRESAKRNDYINNVQEAFDKLYKK EDIEKLFFLIENSKKHEKYKIREYYHKIIGRKNDKENFAKIIYEEIQNVNNIK ELIEKIPDMSELKKSQVFYKYYLDKEELNDKNIKYAFCHFVEIEMSQLLKN YVYKRLSNISNDKIKRIFEYQNLKKLLNKLDTYVRNCGKYNYYLQV GEIATSDFIARNRQNEAFLRNIIGVSSVAYFSLRNILETENENDITGRMRGK TVKNNKGEEKYVSGEVDKIYNENKQNEVKENLKMFYSYDFNMDNKNEIE DFFANIDEAISSIRHGIVHFNLELEGKDIFAFKNIAPSEISKKMFQNEINEKK LKLKIFKQLNSANVFNYYEKDVIIKYLKNTKFNFVNKNIPFVPSFTKLYNKI EDLRNTLKFFWSVPKDKEEKDAQIYLLKNIYYGEFLNKFVKNSKVFFKITN |

TABLE 8-continued

| | | | |
|---|---|---|---|
| | | | EVIKINKQRNQKTGHYKYQKFENIEKTVPVEYLAIIQSREMINNQDKEEKN
TYIDFIQQIFLKGFIDYLNKNNLKYIESNNNNDNNDIFSKIKIKKDNKEKYD
KILKNYEKHNRNKEIPHEINEFVREIKLGKILKYTENLNMFYLILKLLNHKE
LTNLKGSLEKYQSANKEETFSDELELINLLNLDNNRVTEDFELEANEIGKF
LDFNENKIKDRKELKKFDTNKIYFDGENIIKHRAFYNIKKYGMLNLLEKIA
DKAKYKISLKELKEYSNKKNEIEKNYTMQQNLHRKYARPKKDEUNDED
YKEYEKAIGNIQKYTHLKNKVEFNELNLLQGLLLKILHRLVGYTSIWERDL
RFRLKGEFPENHYIEEIFNFDNSKNVKYKSGQIVEKYINFYKELYKDNVEK
RSIYSDKKVKKLKQEKKDLYIRNYIAHFNYIPHAEISLLEVLENLRKLLSYD
RKLKNAIMKSIVDILKEYGFVATFKIGADKKIEIQTLESEKIVHLKNLKKKK
LMTDRNSEELCELVKVMFEYKALE |
| c2c2-14 | 15 | *Rhodobacter capsulatus* SB 1003 (SEQ ID NO: 137) | MQIGKVQGRTISEFGDPAGGLRKRKISTDGKNRKELPAHLSSDPKALIGQWI
SGIDKIYRKPDSRKSDGKAIHSPTPSKMQFDARDDLGEAFWKLVSEAGLA
QDSDYDQFKRRLHPYGDKFQPADSGAKLKFEADPPEPQAFHGRWYGAM
SKRGNDAKELAAALYEHLHVDEKRIDGQPKRNPKTDKFAPGLVVARALGI
ESSVLPRGMARLARNWGEEEIQTYFVVDVAASVKEVAKAAVSAAQAFDP
PRQVSGRSLSPKVGFALAEHLERVTGSKRCSFDPAAGPSVLALHDEVKKTY
KRLCARGKNAARAFPADKTELLALMRHTHENRVRNQMVRMGRVSEYRG
QQAGDLAQSHYWTSAGQTEIKESEIFVRLWVGAFALAGRSMKAWIDPMG
KIVNTEKNDRDLTAAVNIRQVISNKEMVAEAMARRGIYFGETPELDRLGA
EGNEGFVFALLRYLRGCRNQTFHLGARAGFLKEIRKELEKTRWGKAKEAE
HVVLTDKTVAAIRAIIDNDAKALGARLLADLSGAFVAHYASKEHFSTLYSE
IVKAVKDAPEVSSGLPRLKLLLKRADGVRGYVHGLRDTRKHAFATKLPPP
PAPRELDDPATKARYIALLRLYDGPFRAYASGITGTALAGPAARAKEAATA
LAQSVNVTKAYSDVMEGRTSRLRPPNDGETLREYLSALTGETATEFRVQI
GYESDSENARKQAEFIENYRRDMLAFMFEDYIRAKGPDWILKIEPGATAM
TRAPVLPEPIDTRGQYEHWQAALYLVMHFVPASDVSNLLHQLRKWEALQ
GKYELVQDGDATDQADARREALDLVKFRDVLVLFLKTGEARFEGRAAP
FDLKPFRALFANPATFDRLFMATPTTARPAEDDPEGDGASEPELRVARTL
RGLRQIARYNHMAVLSDLFAKHKVRDEEVARLAEIEDETQEKSQIVAAQE
LRTDLHDKVMKCHPKTISPEERQSYAAAIKTIEEHRFLVGRVYLGDHLRL
HRLMMDVIGRLIDYAGAYERDTGTFLINASKQLGAGADWAVTIAGAANT
DARTQTRKDLAHFNVLDRADGTPDLTALVNRAREMMAYDRKRKNAVPR
SILDMLARLGLTLKWQMKDHLLQDATITQAAIKHLDKVRLTVGGPAAVT
EARFSQDYLQMVAAVFNGSVQNPKPRRRDDGDAWHKPPKPATAQSQPD
QKPPNKAPSAGSRLPPPQVGEVYEGVVVKVIDTGSLGFLAVEGVAGNIGLH
ISRLRRIREDAIIVGRRYRFRVEIYVPPKSNTSKLNAADLVRID |
| c2c2-15 | 16 | *Rhodobacter capsulatus* R121 (SEQ ID NO: 138) | MQIGKVQGRTISEFGDPAGGLRKRKISTDGKNRKELPAHLSSDPKALIGQWI
SGIDKIYRKPDSRKSDGKAIHSPTPSKMQFDARDDLGEAFWKLVSEAGLA
QDSDYDQFKRRLHPYGDKFQPADSGAKLKFEADPPEPQAFHGRWYGAM
SKRGNDAKELAAALYEHLHVDEKRIDGQPKRNPKTDKFAPGLVVARALGI
ESSVLPRGMARLARNWGEEEIQTYFVVDVAASVKEVAKAAVSAAQAFDP
PRQVSGRSLSPKVGFALAEHLERVTGSKRCSFDPAAGPSVLALHDEVKKTY
KRLCARGKNAARAFPADKTELLALMRHTHENRVRNQMVRMGRVSEYRG
QQAGDLAQSHYWTSAGQTEIKESEIFVRLWVGAFALAGRSMKAWIDPMG
KIVNTEKNDRDLTAAVNIRQVISNKEMVAEAMARRGIYFGETPELDRLGA
EGNEGFVFALLRYLRGCRNQTFHLGARAGELKEIRKELEKTRWGKAKEAE
HVVLTDKTVAAIRAIIDNDAKALGARLLADLSGAFVAHYASKEHESTLYSE
IVKAVKDAPEVSSGLPRLKLLLKRADGVRGYVHGLRDTRKHAFATKLPPP
PAPRELDDPATKARYIALLRLYDGPFRAYASGITGTALAGPAARAKEAATA
LAQSVNVTKAYSDVMEGRSSRLRPPNDGETLREYLSALTGETATEFRVQI
GYESDSENARKQAEFIENYRRDMLAFMFEDYIRAKGEDWILKIEPGATAM
TRAPVLPEPIDTRGQYEHWQAALYLVMHFVPASDVSNLLHQLRKWEALQ
GKYELVQDGDATDQADARREALDLVKFRDVLVLFLKTGEARFEGRAAP
FDLKPFRALFANPATFDRLFMATPTTARPAEDDPEGDGASEPELRVARTL
RGLRQIARYNHMAVLSDLFAKHKVRDEEVARLAEIEDETQEKSQIVAAQE
LRTDLHDKVMKCHPKTISPEERQSYAAAIKTIEEHRELVGRVYLGDHLRL
HRLMMDVIGRLIDYAGAYERDTGTFLINASKQLGAGADWAVTIAGAANT
DARTQTRKDLAHFNVLDRADGTPDLTALVNRAREMMAYDRKRKNAVPR
SILDMLARLGLTLKWQMKDHLLQDATITQAAIKHLDKVRLTVGGPAAVT
EARFSQDYLQMVAAVENGSVQNPKPRRRDDGDAWHKPPKPATAQSQPD
QKPPNKAPSAGSRLPPPQVGEVYEGVVVKVIDTGSLGFLAVEGVAGNIGLH
ISRLRRIREDAIIVGRRYRFRVEIYVPPKSNTSKLNAADLVRID |
| c2c2-16 | 17 | *Rhodobacter capsulatus* DE442 (SEQ ID NO: 139) | MQIGKVQGRTISEFGDPAGGLRKRKISTDGKNRKELPAHLSSDPKALIGQWI
SGIDKIYRKPDSRKSDGKAIHSPTPSKMQFDARDDLGEAFWKLVSEAGLA
QDSDYDQFKRRLHPYGDKFQPADSGAKLKFEADPPEPQAFHGRWYGAM
SKRGNDAKELAAALYEHLHVDEKRIDGQPKRNPKTDKFAPGLVVARALGI
ESSVLPRGMARLARNWGEEEIQTYFVVDVAASVKEVAKAAVSAAQAFDP
PRQVSGRSLSPKVGFALAEHLERVTGSKRCSFDPAAGPSVLALHDEVKKTY
KRLCARGKNAARAFPADKTELLALMRHTHENRVRNQMVRMGRVSEYRG
QQAGDLAQSHYWTSAGQTEIKESEIFVRLWVGAFALAGRSMKAWIDPMG
KIVNTEKNDRDLTAAVNIRQVISNKEMVAEAMARRGIYFGETPELDRLGA
EGNEGFVFALLRYLRGCRNQTFHLGARAGFLKEIRKELEKTRWGKAKEAE
HVVLTDKTVAAIRAIIDNDAKALGARLLADLSGAFVAHYASKEHFSTLYSE
IVKAVKDAPEVSSGLPRLKLLLKRADGVRGYVHGLRDTRKHAFATKLPPP
PAPRELDDPATKARYIALLRLYDGPFRAYASGITGTALAGPAARAKEAATA
LAQSVNVTKAYSDVMEGRSSRLRPPNDGETLREYLSALTGETATEFRVQI |

TABLE 8-continued

|  |  |  |
|---|---|---|
|  |  | GYESDSENARKQAEFIENYRRDMLAFMFEDYIRAKGFDWILKIEPGATAM<br>TRAPVLPEPIDTRGQYEHWQAALYLVMHFVPASDVSNLLHQLRKWEALQ<br>GKYELVQDGDATDQADARREALDLVKRFRDVLVLFLKTGEARFEGRAAP<br>FDLKPFRALFANPATFDRLFMATPTTARPAEDDPEGDGASEPELRVARTL<br>RGLRQIARYNHMAVLSDLFAKHKVRDEEVARLAEIEDETQEKSQIVAAQE<br>LRTDLHDKVMKCHPKTISPEERQSYAAAIKTIEEHRELVGRVYLGDHLRL<br>HRLMMDVIGRLIDYAGAYERDTGTFLINASKQLGAGADWAVTIAGAANT<br>DARTQTRKDLAHFNVLDRADGTPDLTALVNRAREMMAYDRKRKNAVPR<br>SILDMLARLGLTLKWQMKDHLLQDATITQAAIKHLDKVRLTVGGPAAVT<br>EARFSQDYLQMVAAVENGSVQNPKPRRRDDGDAWHKPPKPATAQSQPD<br>QKPPNKAPSAGSRLPPPQVGEVYEGVVVKVIDTGSLGFLAVEGVAGNIGLH<br>ISRLRRIREDAIIVGRRYRFRVEIYVPPKSNTSKLNAADLVRID |
| c2c2-2 | (SEQ ID<br>NO: 140) | MGNLFGHKRWYEVRDKKDFKIKRKVKVKRNYDGNKYILNINENNNKEKI<br>DNNKFIRKYINYKKNDNILKEFTRKFHAGNILFKLKGKEGIIRIENNDDFLE<br>TEEVVLYIEAYGKSEKLKALGITKKKIIDEAIRQGITKDDKKIEIKRQENEEE<br>IEIDIRDEYTNKTLNDCSIILRIIENDELETKKSIYEIFKNINMSLYKIIEKIIEN<br>ETEKVFENRYYEEHLREKLLKDDKIDVILTNEMEIREKIKSNLEILGFVKFY<br>LNVGGDKKKSKNKKMLVEKILNINVDLTVEDIADEVIKELEFWNITKRIEK<br>VKKVNNEFLEKRRNRTYIKSYVLLDKHEKFKIERENKKDKIVKFFVENIKN<br>NSIKEKIEKILAEFKIDELIKKLEKELKKGNCDTEIEGIFKKHYKVNEDSKKE<br>SKKSDEEEKELYKIIYRYLKGRIEKILVNEQKVRLKKMEKIEIEKILNESILSEK<br>ILKRVKQYTLEHIMYLGKLRHNDIDMTTVNTDDFSRLHAKEELDLELITFF<br>ASTNMELNKIFSRENINNDENIDEFGGDREKNYVLDKKILNSKIKIIRDLDF<br>IDNKNNITNNFIRKFTKIGTNERNRILHAISKERDLQGTQDDYNKVINIIQN<br>LKISDEEVSKALNLDVVEKDKKNIITKINDIKISEENNNDIKYLPSFSKVLPE<br>ILNLYRNNPKNEPFDTIETEKIVLNALIYVNKELYKKLILEDDLEENESKNI<br>FLQELKKTLGNIDEIDENIIENYYKNAQISASKGNNKAIKKYQKKVIECYIGY<br>LRKNYEELFDFSDFKMNIQEIKKQIKDINDNKTYERITVKTSDKTIVINDDF<br>EYIISIFALLNSNAVINKIRNREFATSVWLNTSEYQNIIDILDEIMQLNTLRN<br>ECITENWNLNLEEFIQKMKEIEKDFDDDFKIQTKKEIENNYYEDIKNNILTE<br>FKDDINGCDVLEKKLEKIVIEDDETKFEIDKKSNILQDEQRKLSNINKKDLK<br>KKVDQYIKDKDQEIKSKILCRIIENSDFLKKYKKEIDNLIEDMESENENKFQ<br>EIYYPKERKNELYIYKKNLELNIGNPNEDKIYGLISNDIKMADAKFLENIDG<br>KNIRKNKISEIDAILKNLNDKLNGYSKEYKEKYIKKLKENDDFFAKNIQNK<br>NYKSFEKDYNRVSEYKKIRDLVEFNYLNKIESYLIDINWKLAIQMARFERD<br>MHYIVNGLRELGIIKLSGYNTGISRAYPKRNGSDGFYTTTAYYKFFDEESYK<br>KFEKICYGEGIDLSENSEINKPENESIRNYISHFYIVRNPFADYSIAEQIDRVS<br>NLLSYSTRYNNSTYASVFEVEKKDVNLDYDELKKKFKLIGNNDILERLMKP<br>KKVSVLELESYNSDYIKNLIIELLTKIENTNDTL |
| c2c2-3 | L wadei<br>(Lw2)<br>(SEQ ID<br>NO: 141) | MKVTKVDGISHKKYIEEGKLVKSTSEENRTSERLSELLSIRLDIYIKNPDNA<br>SEEENRIRRENLKKFFSNKVLHLKDSVLYLKNRKEKNAVQDKNYSEEDISE<br>YDLKNKNSFSVLKKILLNEDVNSEELEIFRKDVEAKLNKINSLKYSFEENK<br>ANYQKINENNVEKVGGKSKRNIIYDYYRESAKRNDYINNVQEAFDKLYKK<br>EDIEKLEFLIENSKKHEKYKIREYYHKIIGRKNDKENFAKIIYEEIQNVNIK<br>ELIEKIPDMSELKKSQVFYKYYLDKEELNDKNIKYAFCHFVEIEMSQLLKN<br>YVYKRLSNISNDKIKRIFEYQNLKKLIENKLLNKLDTYVRNCGKYNYYLQV<br>GEIATSDFIARNRQNEAFLRNIIGVSSVAYFSLRNILETENENDITGRMRGK<br>TVKNNKGEEKYVSGEVDKIYNENKQNEVKENLKMFYSYDFNMDNKNEIE<br>DFFANIDEAISSIRHGIVHFNLELEGKDIFAFKNIAPSEISKKMFQNEINEKK<br>LKLKIFKQLNSANVFNYYEKDVIIKYLKNTKFNFVNKNIPFVPSFTKLYNKI<br>EDLRNTLKFFWSVPKDKEEKDAQIYLLKNIYYGEFLNKFVKNSKVFFKITN<br>EVIKINKQRNQKTGHYKYQKFENIEKTVPVEYLAIIQSREMINNQDKEEKN<br>TYIDFIQQIFLKGFIDYLNKNNLKYIESNNNNDNNDIFSKIKIKKDNKEKYD<br>KILKNYEKHNRNKEIPHEINEFVREIKLGKILKYTENLNMFYLILKLLNHKE<br>LTNLKGSLEKYQSANKEETFSDELELINLLNLDNNRVTEDFELEANEIGKF<br>LDFNENKIKDRKELKKFDTNKIYFDGENIIKHRAFYNIKKYGMLNLLEKIA<br>DKAKYKISLKELKEYSNKKNEIEKNYTMQQNLHRKYARPKKDEUNDED<br>YKEYEKAIGNIQKYTHLKNKVEFNELNLLQGLLLKILHRLVGYTSIWERDL<br>RFRLKGEFPENHYIEEIFNFDNSKNVKYKSGQIVEKYINFYKELYKDNVEK<br>RSIYSDKKVKKLKQEKKDLYIRNYIAHFNYIPHAEISLLEVLENLRKLLSYD<br>RKLKNAIMKSIVDILKEYGFVATFKIGADKKIEIQTLESEKIVHLKNLKKKK<br>LMTDRNSEELCELVKVMFEYKALEKRPAATKKAGQAKKKKGSYPYDVPD<br>YAYPYDVPDYAYPYDVPDYA* |
| c2c2-4 | Listeria<br>seeligeri<br>(SEQ ID<br>NO: 142) | MWISIKTLIHHLGVLFFCDYMYNRREKKIIEVKTMRITKVEVDRKKVLISR<br>DKNGGKLVYENEMQDNTEQIMHHKSSFYKSVVNKTICRPEQKQMKKLV<br>HGLLQENSQEKIKVSDVTKLNISNFLNHRFKKSLYYPPENSPDKSEEYRIEI<br>NLSQLLEDSLKKQQGTFICWESFSKDMELYINWAENYISSKTKLIKKSIRN<br>NRIQSTESRSGQLMDRYMKDILNKNKPFDIQSVSEKYQLEKLTSALKATFK<br>EAKKNDKEINYKLKSTLQNHERQIIEELKENSELNQFNIEIRKHLETYFPIK<br>KTNRKVGDIRNLEIGEIQKIVNHRLKNKIVQRILQEGKLASYEIESTVNSNS<br>LQKIKIEEAFALKFINACLFASNNLRNMVYPVCKKDILMIGEFKNSFKEIKH<br>KKFIRQWSQFFSQEITVDDIELASWGLRGAIAPIRNEIIHLKKHSWKKFEN<br>NPTFKVKKSKIINGKTKDVTSEFLYKETLFKDYFYSELDSVPELIINKMESS<br>KILDYYSSDQLNQVFTIPNFELSLLTSAVPFAPSFKRVYLKGFDYQNQDEA<br>QPDYNLKLNIYNEKAFNSEAFQAQYSLFKMVYYQVFLPQFTTNNDLFKSS<br>VDFILTLNKERKGYAKAFQDIRKMNKDEKPSEYMSYIQSQLMLYQKKQEE<br>KEKINHFEKFINQVFIKGFNSFIEKNRLTYICHPTKNTVPENDNIEIPFHTD |

TABLE 8-continued

```
MDDSNIAFWLMCKLLDAKQLSELRNEMIKFSCSLQSTEEISTFTKAREVIG
LALLNGEKGCNDWKELFDDKEAWKKNMSLYVSEELLQSLPYTQEDGQTP
VINRSIDLVKKYGTETILEKLFSSSDDYKVSAKDIAKLHEYDVTEKIAQQES
LHKQWIEKPGLARDSAWTKKYQNVINDISNYQWAKTKVELTQVRHLHQ
LTIDLLSRLAGYMSIADRDFQFSSNYILERENSEYRVTSWILLSENKNKNKY
NDYELYNLKNASIKVSSKNDPQLKVDLKQLRLTLEYLELFDNRLKEKRNN
ISHFNYLNGQLGNSILELFDDARDVLSYDRKLKNAVSKSLKEILSSHGMEV
TFKPLYQTNHHLKIDKLQPKKIHHLGEKSTVSSNQVSNEYCQLVRTLLTM
K
```

In certain embodiments, Cas13b is from an organism selected from Bergeyella, Prevotella, Porphyromonas, Bacteroides, Alistipes, Riemerella, Capnocytophaga, Flavobacterium, Myroides, Chryseobacterium, Paludibacter, Psychroflexus, Phaeodactylibacter Sinomicrobium, and Reichenbachiella.

In certain embodiments, Cas13b is from an organism selected from Bergeyella zoohelcum, Prevotella intermedia, Prevotella buccae, Porphyromonas gingivalis, Bacteroides pyogenes, Alistipes sp. ZOR0009, Prevotella sp. MA2016, Prevotella sp. MA2016, Riemerella anatipestifer, Prevotella aurantiaca, Prevotella saccharolytica, HMPREF9712_03108 [Myroides odoratimimus CCUG 10230], Prevotella intermedia, Capnocytophaga canimorsus, Porphyromonas gulae, Prevotella sp. P5-125, Flavobacterium branchiophilum, Myroides odoratimimus, Flavobacterium columnare, Porphyromonas gingivalis, Porphyromonas sp. COT-052 OH4946, Prevotella intermedia, PIN17_0200 [Prevotella intermedia 17], Prevotella intermedia, HMPREF6485_0083 [Prevotella buccae ATCC 33574], HMPREF9144_1146 [Prevotella pallens ATCC 700821], HMPREF9714_02132 [Myroides odoratimimus CCUG 12901], HMPREF9711_00870 [Myroides odoratimimus CCUG 3837], HMPREF9699_02005 [Bergeyella zoohelcum ATCC 43767], HMPREF9151_01387 [Prevotella saccharolytica F0055], A343_1752 [Porphyromonas gingivalis JCVI SC001], HMPREF1981_03090 [Bacteroides pyogenes F0041], HMPREF1553_02065 [Porphyromonas gingivalis F0568], HMPREF1988_01768 [Porphyromonas gingivalis F0185], HMPREF1990_01800 [Porphyromonas gingivalis W4087], M573_117042 [Prevotella intermedia ZT], A2033_10205 [Bacteroidetes bacterium GWA2_31_9], SAMN05421542_0666 [Chryseobacterium jejuense], SAMN05444360_11366 [Chryseobacterium carnipullorum], SAMN05421786_1011119 [Chryseobacterium ureilyticum], Prevotella buccae, Porphyromonas gingivalis, Porphyromonas gingivalis, Prevotella pallens, Myroides odoratimimus, Myroides odoratimimus, Prevotella sp. MSX73, Porphyromonas gingivalis, Paludibacter propionicigenes, Porphyromonas gingivalis, Flavobacterium columnare, Psychroflexus torquis, Riemerella anatipestifer, Prevotella pleuritidis, Porphyromonas gingivalis, Porphyromonas gingivalis, Porphyromonas gingivalis, Porphyromonas gingivalis, Porphyromonas gingivalis, Prevotella falsenii, Prevotella pleuritidis, [Porphyromonas gingivalis, Porphyromonas gulae, Porphyromonas gulae, Porphyromonas gulae, Porphyromonas gulae, Porphyromonas gulae, Porphyromonas gulae, Porphyromonas gulae, Capnocytophaga cynodegmi, Prevotella sp. P5-119, Prevotella sp. P4-76, Prevotella sp. P5-60, Phaeodactylibacter xiamenensis, Flavobacterium sp. 316, Porphyromonas gulae, WP_047431796, Riemerella anatipestifer, Porphyromonas gingivalis, Porphyromonas gingivalis, Flavobacterium columnare, Porphyromonas gingivalis, Porphyromonas gingivalis, Riemerella anatipestifer, Flavobacterium columnare, Riemerella anatipestifer, Sinomicrobium oceani, and Reichenbachiella agariperforans.

In certain embodiments, the effector protein may be a Listeria sp. C2c2p, preferably Listeria seeligeria C2c2p, more preferably Listeria seeligeria serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a Leptotrichia sp. C2c2p, preferably Leptotrichia shahii C2c2p, more preferably Leptotrichia shahii DSM 19757 C2c2p and the crRNA sequence may be 42 to 58 nucleotides in length, with a 5'direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

More preferably, the effector protein may be a Leptotrichia sp., preferably Leptotrichia wadei F0279, or a Listeria sp., preferably Listeria newyorkensis FSL M6-0635.

In certain embodiments, the effector protein may be a Type VI loci effector protein, more particularly a C2c2 or Cas13b, and the crRNA sequence may be 36 to 63 nucleotides in length, preferably 37-nt to 62-nt in length, or 38-nt to 61-nt in length, or 39-nt to 60-nt in length, more preferably 40-nt to 59-nt in length, or 41-nt to 58-nt in length, most preferably 42-nt to 57-nt in length. For example, the crRNA may comprise, consist essentially of or consist of a direct repeat (DR), preferably a 5' DR, 26-nt to 31-nt in length, preferably 27-nt to 30-nt in length, even more preferably 28-nt or 29-nt in length or at least 28 or 29 nt in length, and a spacer 10-nt to 32-nt in length, preferably 11-nt to 31-nt in length, more preferably 12-nt to 30-nt in length, even more preferably 13-nt to 29-nt in length, and most preferably 14-nt to 28-nt in length, such as 18-28 nt, 19-28 nt, 20-28 nt, 21-28 nt, or 22-28 nt.

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wildtype orthologue sequences of Cas13c are provided in Table 9 below.

TABLE 9

Name
EHO19081 (SEQ. ID. No. 124)

WP_094899336
WP_040490876
WP_047396607
WP_035935671
WP_035906563
WP_042678931
WP_062627846
WP_005959231

TABLE 9-continued

Name
EHO19081 (SEQ. ID. No. 124)

WP_027128616
WP_062624740
WP_096402050

The application further provides orthologs of C2c2 which demonstrate robust activity making them particularly suitable for different applications of RNA cleavage and detection. These applications include but are not limited to those described herein. More particularly, an ortholog which is demonstrated to have stronger activity than others tested is the C2c2 ortholog identified from the organism *Leptotrichia wadei* (LwC2c2). The application thus provides methods for modifying a target locus of interest, comprising delivering to said locus a non-naturally occurring or engineered composition comprising a CRISPR effector protein, more particularly a CRISPR effector protein with increased activity as described herein and one or more nucleic acid components, wherein at least the one or more nucleic acid components is engineered, the one or more nucleic acid components directs the complex to the target of interest and the effector protein forms a complex with the one or more nucleic acid components and the complex binds to the target locus of interest. In particular embodiments, the target locus of interest comprises RNA. The application further provides for the use of the C2c2 effector proteins with increased activity in RNA sequence specific interference, RNA sequence specific gene regulation, screening of RNA or RNA products or lincRNA or non-coding RNA, or nuclear RNA, or mRNA, mutagenesis, Fluorescence in situ hybridization, or breeding.

In some embodiments, the Cas sequence is fused to one or more nuclear localization sequences (NLSs) or nuclear export signals (NESs), such as about or more than about 1, 2, 3, 4, 5, 6, 7, 8, 9, 10, or more NLSs or NESs. In some embodiments, the Cas comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g. zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In a preferred embodiment of the invention, the Cas comprises at most 6 NLSs. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 143; the NLS from nucleoplasmin (e.g. the nucleoplasmin bipartite with NLS the sequence KRPAATKKAGQAKKKK) (SEQ ID NO: 144); the c-myc NLS having the amino acid sequence PAAKRVKLD (SEQ ID NO: 145) or RQRRNELKRSP (SEQ ID NO: 146); the hRNPA1 M9 NLS having the sequence NQSSNFGPMKGGNFGGRSSGPYGGGGQYFAKPRNQGGY (SEQ ID NO: 147); the sequence RMRIZFKNKGKDTAELRRRRVEVSVELRKAKKD-EQILKRRNV (SEQ ID NO:148) of the IBB domain from importin-alpha; the sequences VSRKRPRP (SEQ ID NO: 149) and PPKKARED (SEQ ID NO: 150) of the myoma T protein; the sequence POPKKKPL (SEQ ID NO: 151) of human p53; the sequence SALIKKKKKMAP (SEQ ID NO: 152) of mouse c-abl IV; the sequences DRLRR (SEQ ID NO: 153) and PKQKKRK (SEQ ID NO: 154) of the influenza virus NS1; the sequence RKLKKKIKKL (SEQ ID NO: 155) of the Hepatitis virus delta antigen; the sequence REKKKFLKRR (SEQ ID NO: 156) of the mouse Mx1 protein; the sequence KRKGDEVDGVDEVAKKKSKK (SEQ ID NO: 157) of the human poly(ADP-ribose) polymerase; and the sequence RKCLQAGMNLEARKTKK (SEQ ID NO: 158) of the steroid hormone receptors (human) glucocorticoid. Non-limiting examples of NESs include an NES sequence LYPERLRRILT (SEQ ID No, 159) (ctgtaccctgagcggctgcggcggatcctgacc (SEQ. ID. No. 160). In general, the one or more NLSs or NESs are of sufficient strength to drive accumulation of the Cas in a detectable amount in respectively the nucleus or the cytoplasm of a eukaryotic cell. In general, strength of nuclear localization/export activity may derive from the number of NLSs/NESs in the Cas, the particular NLS(s) or NES(s) used, or a combination of these factors. Detection of accumulation in the nucleus/cytoplasm may be performed by any suitable technique. For example, a detectable marker may be fused to the Cas, such that location within a cell may be visualized, such as in combination with a means for detecting the location of the nucleus (e.g. a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs or NESs. In certain embodiments, other localization tags may be fused to the Cas protein, such as without limitation for localizing the Cas to particular sites in a cell, such as organells, such mitochondria, plastids, chloroplast, vesicles, golgi, (nuclear or cellular) membranes, ribosomes, nucleoluse, ER, cytoskeleton, vacuoles, centrosome, nucleosome, granules, centrioles, etc.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the CRISPR enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, In an aspect the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a CRISPR enzyme which has a diminished nuclease activity of at least 97%, or 100% as compared with the CRISPR enzyme not having the at least one mutation. In an aspect the invention provides a herein-discussed composition, wherein the CRISPR enzyme comprises two or more mutations. The mutations may be selected from mutations of one or more of the following amino acid residues: R597, H602, R1278, and H1283, such as for instance one or more of the following mutations: R597A, H602A, R1278A, and H1283A, according to *Leptotrichia shahii* CRISPR protein or a corresponding position in an ortholog.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KUI, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one gRNA, and the gRNAs target different sequences whereby when the composition is employed, there is multiplexing. In an aspect the invention provides a composition wherein there is more than one gRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS can be used. They can be used in repeats of 3 ((GGGGS)3) or 6, 9 or even 12 (SEQ ID Nos. 161-164) or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting Cas protein has no more than 5% of the activity of the nucleic acid-targeting Cas protein not having the at least one mutation and, optionally, at least one or more nuclear localization sequences; the guide RNA comprises a guide sequence capable of hybridizing to a target sequence in a RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

Destabilized CRISPR Effector

In certain embodiments, the effecteor protein (CRISPR enzyme; e.g. Cas13a, Cas13b, or Cas 13c) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT. or CMP8 In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-C2c2 or DHFR-DHFR-C2c2 It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to (GGGGS)3.

Destabilizing domains have general utility to confer instability to a wide range of proteins; see, e.g., Miyazaki, J Am Chem Soc. Mar. 7, 2012; 134 (9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3B.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme and its stability can be regulated or perturbed using a ligand, whereby the CRISPR enzyme has a DD. Another DD can be a 12-kDa (107-amino-acid) tag based on a mutated FKBP protein, stabilized by Shield1 ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19 (3): 391-398-all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled-turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

In certain embodiments, the activity of the CRISPR effector depends on the presence of two HEPN domains. These have been shown to be RNase domains, i.e. nuclease (in particular an endonuclease) cutting RNA. C2c2 HEPN may also target DNA, or potentially DNA and/or RNA. On the basis that that the HEPN domains of C2c2 are at least capable of binding to and, in their wild-type form, cutting RNA, then it is preferred that the CRISPR effector, such as C2c2 or Cas13b effector protein has RNase function. It may also, or alternatively, have DNase function.

Thus, in some embodiments, the effector protein may be a RNA-binding protein, such as a dead-Cas type effector protein, which may be optionally functionalised as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. In the *Staphylococcus epidermis* type III-A system, transcription across targets results in cleavge of the target DNA and its transcripts, mediated by independent active sites within the Cas10-Csm ribonucleoprotein effector complex (see, Samai et al., 2015, Cell, vol. 151, 1164-1174). A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA. In other embodiments, the target RNA may include miRNA. In other embodiments, the target RNA may include siRNA.

Guide RNAs

As used herein, the term "guide sequence," "crRNA" or "guide RNA" or "single guide RNA," "gRNA" refers to a polynucleotide comprising any polynucleotide sequence having sufficient complementarity with a target nucleic acid sequence to hybridize with the target nucleic acid sequence and to direct sequence-specific binding of a RNA-targeting complex comprising the gRNA and a CRISPR effector protein to the target nucleic acid sequence. In general, a gRNA may be any polynucleotide sequence (i) being able to form a complex with a CRISPR effector protein and (ii) comprising a sequence having sufficient complementarity with a target polynucleotide sequence to hybridize with the target sequence and direct sequence-specific binding of a CRISPR complex to the target sequence. As used herein the term "capable of forming a complex with the CRISPR effector protein" refers to the gRNA having a structure that allows specific binding by the CRISPR effector protein to the gRNA such that a complex is formed that is capable of binding to a target RNA in a sequence specific manner and that can exert a function on said target RNA. Structural components of the gRNA may include direct repeats and a guide sequence (or spacer). The sequence specific binding to the target RNA is mediated by a part of the gRNA, the "guide sequence", being complementary to the target RNA. In embodiments of the invention the term guide RNA, i.e. RNA capable of guiding Cas to a target locus, is used as in foregoing cited documents such as WO 2014/093622 (PCT/US2013/074667). As used herein the term "wherein the guide sequence is capable of hybridizing" refers to a subsection of the gRNA having sufficient complementarity to the target sequence to hybridize thereto and to mediate binding of a CRISPR complex to the target RNA. In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at novocraft.com), ELAND (Illumina, San Diego, CA), SOAP (available at soap.genomics.org.cn), and Maq (available at maq.sourceforge.net).

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33 (9): 985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree of secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106 (1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length (i.e. guide sequence length or spacer sequence length) of the guide RNA is from 15 to 35 nt. In certain embodiments, the spacer length of the guide RNA is from 18 to 35 nt. In certain embodiments, the spacer length of the guide RNA is from 19 to 33 nt. In certain embodiments, the spacer length of the guide RNA is from 20 to 30 nt. In certain embodiments, the spacer length of the guide RNA is at least 15 nucleotides, preferably at least 18 nt, such as at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In certain embodiments, the spacer length is 18 to 30 nucleotides. In certain embodiments, the spacer length is 19 to 30 nucleotides. In certain embodiments, the spacer length is 20 to 30 nucleotides. In certain embodiments, the spacer length is 21 to 30 nucleotides. In certain embodiments, the spacer length is 22 to 30 nucleotides. In certain embodiments, the spacer length is 23 to 30 nucleotides. In certain embodiments, the spacer length is 24 to 30 nucleotides. In certain embodiments, the spacer length is 25 to 30 nucleotides. In certain embodiments, the spacer length is 26 to 30 nucleotides. In certain embodiments, the spacer length is 27 to 30 nucleotides. In certain embodiments, the spacer length is 28 to 30 nucleotides. In certain embodiments, the spacer length is 29 to 30 nucleotides. In certain embodiments, the spacer length is 18 to 29 nucleotides. In certain embodiments, the spacer length is 19 to 29 nucleotides. In certain embodiments, the spacer length is 20 to 29 nucleotides. In certain embodiments, the spacer length is 21 to 29 nucleotides. In certain embodiments, the spacer length is 22 to 29 nucleotides. In certain embodiments, the spacer length is 23 to 29 nucleotides. In certain embodiments, the spacer length is 24 to 29 nucleotides. In certain embodiments, the spacer length is 25 to 29 nucleotides. In certain embodiments, the spacer length is 26 to 29 nucleotides. In certain embodiments, the spacer length is 27 to 29 nucleotides. In certain embodiments, the spacer length is 28 to 29 nucleotides. In certain embodiments, the spacer length is 18 to 28 nucleotides. In certain embodiments, the spacer length is 19 to 28 nucleotides. In certain embodiments, the spacer length is 20 to 28 nucleotides. In certain embodiments, the spacer length is 21 to 28 nucleotides. In certain embodiments, the spacer length is 22 to 28 nucleotides. In certain embodiments, the spacer length is 23 to 28 nucleotides. In certain embodiments, the spacer length is 24 to 28 nucleotides. In certain embodiments, the spacer length is 25 to 28 nucleotides. In certain embodiments, the spacer length is 26 to 28 nucleotides. In certain embodiments, the spacer length is 27 to 28 nucleotides. In certain embodiments, the spacer length is 18 to 27 nucleotides. In certain embodiments, the spacer length is 19 to 27 nucleotides. In certain embodiments, the spacer length is 20 to 27 nucleotides. In certain embodiments, the spacer length is 21 to 27 nucleotides. In certain embodiments, the spacer length is 22 to 27 nucleotides. In certain embodiments, the spacer length is 23 to 27 nucleotides. In certain embodiments, the spacer length is 24 to 27 nucleotides. In certain embodiments, the spacer length is 25 to 27 nucleotides. In certain embodiments, the spacer length is 26 to 27 nucleotides. In certain embodiments, the spacer length is 18 to 26 nucleotides. In certain embodiments, the spacer length is 19 to 26 nucleotides. In certain embodiments, the spacer length is 20 to 26 nucleotides. In certain embodiments, the spacer length is 21 to 26 nucleotides. In certain embodiments, the spacer length is 22 to 26 nucleotides. In certain embodiments, the spacer length is 23 to 26 nucleotides. In certain embodiments, the spacer length is 24 to 26 nucleotides. In certain embodiments, the spacer length is 25 to 26 nucleotides. In certain embodiments, the spacer length is 18 to 25 nucleotides. In certain embodiments, the spacer length is 19 to 25 nucleotides. In certain embodiments, the spacer length is 20 to 25 nucleotides. In certain embodiments, the spacer length is 21 to 25 nucleotides. In certain embodiments, the spacer length is 22 to 25 nucleotides. In certain embodiments, the spacer length is 23 to 25 nucleotides. In certain embodiments, the spacer length is 24 to 25 nucleotides. In certain embodiments, the spacer length is 18 to 24 nucleotides. In certain embodiments, the spacer length is 19 to 24 nucleotides. In certain embodiments, the spacer length is 20 to 24 nucleotides. In certain embodiments, the spacer length is 21 to 24 nucleotides. In certain embodiments, the spacer length is 22 to 24 nucleotides. In certain embodiments, the spacer length is 23 to 24 nucleotides. In certain embodiments, the spacer length is 18 to 23 nucleotides. In certain embodiments, the spacer length is 19 to 23 nucleotides. In certain embodiments, the spacer length is 20 to 23 nucleotides. In certain embodiments, the spacer length is 21 to 23 nucleotides. In certain embodiments, the spacer length is 22 to 23 nucleotides. In certain embodiments, the spacer length is 18 to 22 nucleotides. In certain embodiments, the spacer length is 19 to 22 nucleotides. In certain embodiments, the spacer length is 20 to 22 nucleotides. In certain embodiments, the spacer length is 21 to 22 nucleotides. In certain embodiments, the spacer length is 18 to 21 nucleotides. In certain embodiments, the spacer length is 19 to 21 nucleotides. In certain embodiments, the spacer length is 20 to 21 nucleotides. In certain embodiments, the spacer length is 18 to 20 nucleotides. In certain embodiments, the spacer length is 19 to 20 nucleotides. In certain embodiments, the spacer length is 18 to 19 nucleotides.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. This aspect is of particular relevance for the diagnostic applications of the present invention, such as in particular the companion diagnostic applications. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For, example the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. the synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end. In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e. one intervening nucleotide).

In certain embodiments, the guide RNA is designed such that the mismatch is located 2 nucleotides downstream of the SNP (i.e. one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

The embodiments described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing CRISPR protein specific equivalents. Structural similarity between, e.g., the orthologous nuclease domains HEPN of two or more CRISPR effector proteins may be used to transfer design equivalent dead guides. Thus, the dead guide herein may be appropriately modified in length and sequence to reflect such CRISPR protein specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at 3'-end that do not match the target sequence. Thus, a dead guide RNA that includes the first 20-28 nt, downstream of a CRISPR motif can be extended in length at 3' end.

Vectors and Expression Systems

In certain aspects the invention involves vectors, e.g. for delivering or introducing in a cell CRISPR effector and/or RNA capable of guiding CRISPR effector to a target locus (i.e. guide RNA), and optionally also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise CRISPR effector encoding sequences, and/or a single, but possibly also can comprise at least 2, 3, 4, 5, 6, 7, or 8 or more, such as 10, 12, 14, 16 or more, such as 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/ taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or CRISPR effector encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

In some embodiments, one or more elements of a nucleic acid-targeting system is derived from a particular organism comprising an endogenous CRISPR RNA-targeting system. In certain example embodiments, the effector protein CRISPR RNA-targeting system comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the effector protein comprises a single HEPN domain. In certain other example embodiments, the effector protein comprises two HEPN domains.

The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in some but not all systems) a trans-activating CRISPR/Cas system RNA (tracrRNA) sequence, or other sequences and transcripts from a DNA or RNA-targeting CRISPR locus. In general, a RNA-targeting system is characterized by elements that promote the formation of a DNA or RNA-targeting complex at the site of a target DNA or RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell.

In an aspect of the invention, novel RNA targeting systems also referred to as RNA- or RNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

In an aspect of the invention, novel DNA targeting systems also referred to as DNA- or DNA-targeting CRISPR/Cas or the CRISPR-Cas system RNA-targeting system of the present application are based on identified Type VI Cas proteins which do not require the generation of customized proteins to target specific RNA sequences but rather a single enzyme can be programmed by a RNA molecule to recognize a specific DNA target, in other words the enzyme can be recruited to a specific DNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector proteinanimal or mammal, e.g., an animal or mammal that constitutively or inducibly or conditionally expresses nucleic acid-targeting effector protein; or an animal or mammal that is otherwise expressing nucleic acid-targeting effector proteinor has cells containing nucleic acid-targeting effector protein, such as by way of prior administration thereto of a vector or vectors that code for and express in vivo nucleic acid-targeting effector protein. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a a nucleic acid-targeting effector protein. nucleic acid-targeting effector protein or nucleic acid-targeting guide RNA or RNA(s) can be delivered separately; and advantageously at least one of these is delivered via a particle or nanoparticle complex. nucleic acid-targeting effector protein mRNA can be delivered prior to the nucleic acid-targeting guide RNA to give time for nucleic acid-targeting effector protein to be expressed. nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome and/or transcriptome modification.

In one aspect, the invention provides methods for using one or more elements of a nucleic acid-targeting system. The nucleic acid-targeting complex of the invention provides an effective means for modifying a target RNA. The nucleic acid-targeting complex of the invention has a wide variety of utility including modifying (e.g., deleting, inserting, translocating, inactivating, activating) a target RNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises a RNA-targeting effector protein complexed with a guide RNA hybridized to a target sequence within the target locus of interest.

In one embodiment, this invention provides a method of cleaving a target RNA. The method may comprise modifying a target RNA using a nucleic acid-targeting complex that binds to the target RNA and effect cleavage of said target RNA. In an embodiment, the nucleic acid-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded DNA or RNA) is introduced into the DNA or RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a nucleic acid-targeting complex that binds to the RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a nucleic acid-targeting complex to bind to the target RNA to effect cleavage of said target RNA or RNA thereby modifying the target RNA, wherein the nucleic acid-targeting complex comprises a nucleic acid-targeting effector protein complexed with a guide RNA hybridized to a target sequence within said target RNA. In one aspect, the invention provides a method of modifying expression of RNA in a eukaryotic cell. In some embodiments, the method comprises allowing a nucleic acid-targeting complex to bind to the RNA such that said binding results in increased or decreased expression of said RNA; wherein the nucleic acid-targeting complex comprises a nucleic acid-targeting effector protein complexed with a guide RNA. Similar considerations and conditions apply as above for methods of modifying a target RNA. In fact, these sampling, culturing and re-introduction options apply across the aspects of the present invention. In one aspect, the invention provides for methods of modifying a target RNA in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving RNA sequence targeting, that relate to the nucleic acid-targeting system and components thereof. In advantageous embodiments, the effector protein enzyme is a Type VI protein such as C2c2. An advantage of the present methods is that the CRISPR system minimizes or avoids off-target binding and its resulting side effects. This is achieved using systems arranged to have a high degree of sequence specificity for the target RNA.

In other example embodiments, the Type VI RNA-targeting Cas enzyme is Cas13d. In certain embodiments, Cas13d is *Eubacterium siraeum* DSM 15702 (EsCas13d) or *Ruminococcus* sp. N15.MGS-57 (RspCas13d) (see, e.g., Yan et al., Cas13d Is a Compact RNA-Targeting Type VI CRISPR Effector Positively Modulated by a WYL-Domain-Containing Accessory Protein, Molecular Cell (2018), doi.org/10.1016/j.molcel.2018.02.028). RspCas13d and EsCas13d have no flanking sequence requirements (e.g., PFS, PAM).

Delivery Generally

CRISPR Effector Protein Complexes can Deliver Functional Effectors

Unlike CRISPR-Cas-mediated gene knockout, which permanently eliminates expression by mutating the gene at the DNA level, CRISPR-Cas knockdown allows for temporary reduction of gene expression through the use of artificial transcription or translation factors. Mutating key residues in both DNA or RNA cleavage domains of the CRISPR protein results in the generation of a catalytically inactive CRISPR protein. A catalytically inactive CRISPR complexes with a guide RNA and localizes to the or RNA sequence specified by that guide RNA's targeting domain, however, it does not cleave the target RNA. Fusion of the inactive CRISPR protein to an effector domain, e.g., a transcription or translation repression domain, enables recruitment of the effector to any or RNA site specified by the guide RNA. In certain embodiments, CRISPR effector may be fused to a transcriptional repression domain and recruited to the promoter region of a gene. Especially for gene repression, it is contemplated herein that blocking the binding site of an endogenous transcription factor would aid in downregulating gene expression. In another embodiment, an inactive CRISPR protein can be fused to a chromatin modifying protein. Altering chromatin status can result in decreased expression of the target gene. In further embodiments, CRISPR protein may be fused to a translation repression domain.

In an embodiment, a guide RNA molecule can be targeted to a known transcription response elements (e.g., promoters, enhancers, etc.), a known upstream activating sequences, and/or sequences of unknown or known function that are suspected of being able to control (protein) expression of the target RNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced. In some methods, a target polynucleotide can be inactivated to effect the modification of the expression in a cell. For example, upon the binding of a CRISPR complex to an RNA target sequence in a cell, the target polynucleotide is inactivated such that the sequence is not translated, affecting the expression level of the protein in the cell.

In particular embodiments, the CRISPR enzyme comprises one or more mutations selected from the group consisting of R597A, H602A, R1278A and H1283A and/or the one or more mutations are in the HEPN domain of the CRISPR enzyme or is a mutation as otherwise discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

Delivery of the CRISPR Effector Protein Complex or Components Thereof

Through this disclosure and the knowledge in the art, TALEs, CRISPR-Cas systems, or components thereof or nucleic acid molecules thereof or nucleic acid molecules encoding or providing components thereof may be delivered by a delivery system herein described both generally and in detail.

Vector delivery, e.g., plasmid, viral delivery: The CRISPR enzyme, for instance a Type VI protein such as C2c2, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^{00}$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9:210-216; Sorensen et al., J. Mol. Biol. 2003, 327:761-766; Lewis et al., Nat. Gen. 2002, 32:107-108 and Simeoni et al., NAR 2003, 31, 11:2717-2724) and may be applied to the present invention. siRNA has recently been successfully used for inhibition of gene expression in primates (see for example. Tolentino et al., Retina 24 (4): 660 which may also be applied to the present invention.

Indeed, RNA delivery is a useful method of in vivo delivery. It is possible to deliver nucleic acid-targeting Cas proteinCas9 and guide RNAgRNA (and, for instance, HR repair template) into cells using liposomes or particles. Thus delivery of the nucleic acid-targeting Cas protein/CRISPR enzyme, such as a CasCas9 and/or delivery of the guide RNAs of the invention may be in RNA form and via microvesicles, liposomes or particles. For example, Cas mRNA and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19:3112-3118, 2010) or exosomes (Schroeder, A., Levins, C., Cortez, C., Langer, R., and Anderson, D., Lipid-based nanotherapeutics for siRNA delivery, Journal of Internal Medicine, 267:9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7 (12): 2112-26. doi: 10.1038/nprot.2012.131. Epub 2012 Nov. 15) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes, in particular but not limited to the brain. Vitamin E (α-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to α-tocopherol and co-administered with HDL targeted to the brain may be contemplated for humans in the present invention, for example, about 3 nmol to about 3 µmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of $1 \times 10^9$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of $1 \times 10^9$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaging and Promoters Generally

Ways to package nucleic acid-targeting effector coding nucleic acid molecules, e.g., DNA, into vectors, e.g., viral vectors, to mediate genome modification in vivo include:
To achieve NHEJ-mediated gene knockout:
Single virus vector:
Vector containing two or more expression cassettes:
Promoter-nucleic acid-targeting effector protein coding nucleic acid molecule-terminator
Promoter—guide RNA1-terminator
Promoter—guide RNA (N)-terminator (up to size limit of vector)
Double virus vector:
Vector 1 containing one expression cassette for driving the expression of nucleic acid-targeting effector protein
Promoter—nucleic acid-targeting effector protein coding nucleic acid molecule-terminator
Vector 2 containing one more expression cassettes for driving the expression of one or more guideRNAs
Promoter—guide RNA1-terminator
Promoter—guide RNA1 (N)-terminator (up to size limit of vector)
To mediate homology-directed repair.
In addition to the single and double virus vector approaches described above, an additional vector is used to deliver a homology-direct repair template.

The promoter used to drive nucleic acid-targeting effector protein coding nucleic acid molecule expression can include:

AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein.

For ubiquitous expression, can use promoters: CMV, CAG, CBh, PGK, SV40, Ferritin heavy or light chains, etc.

For brain or other CNS expression, can use promoters: SynapsinI for all neurons, CaMKIIalpha for excitatory neurons, GAD67 or GAD65 or VGAT for GABAergic neurons, etc.

For liver expression, can use Albumin promoter.
For lung expression, can use SP-B.
For endothelial cells, can use ICAM.
For hematopoietic cells can use IFNbeta or CD45.
For Osteoblasts can use OG-2.
The promoter used to drive guide RNA can include:
Pol III promoters such as U6 or H1
Use of Pol II promoter and intronic cassettes to express guide RNA Adeno Associated Virus (AAV)

nucleic acid-targeting effector protein and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome/transcriptome modification, the expression of nucleic acid-targeting effector protein can be driven by a cell-type specific promoter. For example, liver-specific expression might use the Albumin promoter and neuron-specific expression (e.g., for targeting CNS disorders) might use the Synapsin I promoter.

In terms of in vivo delivery, AAV is advantageous over other viral vectors for a couple of reasons:

Low toxicity (this may be due to the purification method not requiring ultra centrifugation of cell particles that can activate the immune response) and.

Low probability of causing insertional mutagenesis because it doesn't integrate into the host genome.

AAV has a packaging limit of 4.5 or 4.75 Kb. This means that nucleic acid-targeting effector protein (such as a Type VI protein such as C2c2) as well as a promoter and transcription terminator have to be all fit into the same viral vector. Therefore embodiments of the invention include utilizing homologs of nucleic acid-targeting effector protein that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82:5887-5911 (2008)) is as follows:

TABLE 10

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 µg of lentiviral transfer plasmid (pCasES10) and the following packaging plasmids: 5 µg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8:275-285). In another embodiment, RetinoStat®, an equine inffctious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the nucleic acid-targeting system of the present invention. A minimum of 2.5×106 CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of 2× 106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and US Patent No. U.S. Pat. No. 7,259,015.

RNA Delivery

RNA delivery: The nucleic acid-targeting Cas protein, for instance a Type VI protein such as C2c2, and/or guide RNA, can also be delivered in the form of RNA. nucleic acid-targeting Cas protein (such as a Type VI protein such as C2c2) mRNA can be generated using in vitro transcription. For example, nucleic acid-targeting effector protein (such as a Type VI protein such as C2c2) mRNA can be synthesized using a PCR cassette containing the following elements: T7_promoter-kozak sequence (GCCACC)-effector protrein-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the nucleic acid-targeting effector protein-coding sequence and/or the guide RNA can be modified to include one or more modified nucleoside e.g., using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (m). In some embodiments, inventive particles have a greatest dimension of less than 10 m. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1X PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (such as a Type VI protein such as C2c2) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8 (3): 774-87. doi: 10.1021/mp100390w. Epub 2011 Apr. 1) describes biodegradable core-shell structured particles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7 (2): 1016-1026; Siew, A., et al. Mol Pharm, 2012. 9 (1): 14-28; Lalatsa, A., et al. J Contr Rel, 2012. 161 (2): 523-36; Lalatsa, A., et al., Mol Pharm, 2012. 9 (6): 1665-80; Lalatsa, A., et al. Mol Pharm, 2012. 9 (6): 1764-74; Garrett, N. L., et al. J Biophotonics, 2012. 5 (5-6): 458-68; Garrett, N. L., et al. J Raman Spect, 2012. 43 (5): 681-688; Ahmad, S., et al. J Royal Soc Interface 2010. 7: S423-33; Uchegbu, I. F. Expert Opin Drug Deliv, 2006. 3 (5): 629-40; Qu, X., et al. Biomacromolecules, 2006. 7 (12): 3452-9 and Uchegbu, I. F., et al. Int J Pharm, 2001. 224:185-199). Doses of about 5 mg/kg are contemplated, with single or multiple doses, depending on the target tissue.

In one embodiment, particles that can deliver RNA to a cancer cell to stop tumor growth developed by Dan Anderson's lab at MIT may be used/and or adapted to the nucleic acid-targeting system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 August 6; 110 (32): 12881-6; Zhang et al., Adv Mater. 2013 Sep. 6; 25 (33): 4641-5; Jiang et al., Nano Lett. 2013 Mar. 13; 13 (3): 1059-64; Karagiannis et al., ACS Nano. 2012 Oct. 23; 6 (10): 8484-7; Whitehead et al., ACS Nano. 2012 Aug. 28; 6 (8): 6922-9 and Lee et al., Nat Nanotechnol. 2012 Jun. 3; 7 (6): 389-93.

U.S. patent application No. 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-220 December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethyl-ammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-220 December 2011). A dosage of 1 µg/ml of LNP or CRISPR-Cas RNA in or associated with the LNP may be contemplated, especially for a formulation containing DLinKC2-DMA.

Preparation of LNPs and CRISPR-Cas encapsulation may be used/and or adapted from Rosin et al, Molecular Therapy, vol. 19, no. 12, pages 1286-220 December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-0-[2''-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific nucleic acid-targeting complex (CRISPR-Cas) RNA may be encapsulated in LNPs containing DLinDAP, DLinDMA, DLinK-DMA, and DLinKC2-DMA (cationic lipid: DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid: DSPC: cholesterol: PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a nucleic acid-targeting system or components thereof.

Preparation of large LNPs may be used/and or adapted from Rosin et al, Molecular Therapy, vol. 19, no. 12, pages 1286-220 December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate: DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt: wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495: S14-S16, Choi et al., Proc. Natl. Acad. Sci. USA. 2013 110 (19): 7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclodo-decane-1,4,7,10-tetraacetic acid mono(N-hydroxysuccinim-ide ester) (DOTA-NHSester) was ordered from Macrocy-clics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNAby liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m-2 siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of nucleic acid-targeting complex, e.g., nucleic acid-targeting effector protein or mRNA, or guide RNA delivered using particles or lipid envelopes. Other delivery systems or vectors are may be used in conjunction with the particle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, particles of the invention have a greatest dimension of 100 nm or less. In other preferred embodiments, nanoparticles of the invention have a greatest dimension ranging between 35 nm and 60 nm.

Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid.

U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material.

U.S. Pat. No. 5,855,913, incorporated herein by reference, provides a particulate composition having aerodynamically light particles having a tap density of less than 0.4 g/cm3 with a mean diameter of between 5 µm and 30 µm, incorporating a surfactant on the surface thereof for drug delivery to the pulmonary system.

U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system.

U.S. Pat. No. 5,543,158, incorporated herein by reference, provides biodegradable injectable particles having a biodegradable solid core containing a biologically active material and poly(alkylene glycol) moieties on the surface.

WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

In one embodiment, the particle may be epoxide-modified lipid-polymer, advantageously 7C1 (see, e.g., James E. Dahlman and Carmen Barnes et al. Nature Nanotechnology (2014) published online 11 May 2014, doi:10.1038/nnano.2014.84). C71 was synthesized by reacting C15 epoxide-terminated lipids with PEI600 at a 14:1 molar ratio, and was formulated with C14PEG2000 to produce particles (diameter between 35 and 60 nm) that were stable in PBS solution for at least 40 days.

An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29:341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Preexposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 µg of exosomes (measured based on protein concentration) per 106 cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 µF resulted in the greatest retention of RNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshprotocols.cshl-p.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or conmponents thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol)2000) carbamoyl]-1,2-dimyristyloxy-propylamine (PEG-C-DMA), 1,2-dilinoleyloxy-N,N-dimethyl-3-amino-propane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000) carbamoyl]-1,2-dimyrestyloxypropylamine, and cationic 1,2-dilinoleyloxy-3-N,Ndimethylaminopropane (see, e.g., Geisbert et al., Lancet 2010; 375:1896-905). A dosage of about 2 mg/kg total nucleic acid-targeting systemper dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-CDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardio-myopathy (FAC)-both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-Ira were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177).

The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 μm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000) propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11+0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume: 29, Pages: 154-157 (2011)) describes the use of lipid envelopes to deliver RNA. Use of lipid envelopes is also preferred in the present invention.

In another embodiment, lipids may be formulated with the nucleic acid-targeting system of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with RNA-targeting system instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid: siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The nucleic acid-targetingsystem or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid: fusogenic lipid: cholesterol: PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application No. 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7 (2): 1016-26; Uchegbu and Siew, 2013, J Pharm Sci. 102 (2): 305-10 and Lalatsa et al., 2012, J Control Release. 2012 Jul. 20; 161 (2): 523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N-P(O₂)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application No. 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targetingsystem(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targetingsystem(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified+36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines.

(1) One day before treatment, plate 1×10⁵ cells per well in a 48-well plate.
(2) On the day of treatment, dilute purified +36 GFP protein in serumfree media to a final concentration 200 nM. Add RNA to a final concentration of 50 nM. Vortex to mix and incubate at room temperature for 10 min.
(3) During incubation, aspirate media from cells and wash once with PBS.
(4) Following incubation of +36 GFP and RNA, add the protein-RNA complexes to cells.
(5) Incubate cells with complexes at 37° C. for 4h.
(6) Following incubation, aspirate the media and wash three times with 20 U/mL heparin PBS. Incubate cells with serum-containing media for a further 48h or longer depending upon the assay for activity.
(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate 1×10⁵ per well in a 48-well plate.
(2) On the day of treatment, dilute purified p36 GFP protein in serumfree media to a final concentration 2 mM. Add 1 mg of plasmid DNA. Vortex to mix and incubate at room temperature for 10 min.
(3) During incubation, aspirate media from cells and wash once with PBS.
(4) Following incubation of p36 GFP and plasmid DNA, gently add the protein-DNA complexes to cells.
(5) Incubate cells with complexes at 37 C for 4h.
(6) Following incubation, aspirate the media and wash with PBS. Incubate cells in serum-containing media and incubate for a further 24-48h.
(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the nucleic acid-targeting system of the present invention. These systems of Dr. Lui and documents herein in conjunction with herein teachings can be employed in the delivery of nucleic acid-targeting system(s) or component(s) thereof or nucleic acid molecule(s) coding therefor.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the nucleic acid-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically, a few devices are implanted during the same treatment procedure.

US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 $m^3$ to 1000 $mm^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example, the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear--auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the nucleic acid-targeting system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the nucleic acid-targeting system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used/and or adapted to the nucleic acid-targeting system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system or components thereof or nucleic acid molecules thereof or encoding or providing components may be delivered via an implantable device.

CRISPR Effector Protein mRNA and Guide RNA

CRISPR effector protein mRNA and guide RNA might also be delivered separately. CRISPR effector protein mRNA can be delivered prior to the guide RNA to give time for CRISPR effector protein to be expressed. CRISPR effector protein mRNA might be administered 1-12 hours (preferably around 2-6 hours) prior to the administration of guide RNA.

Alternatively, CRISPR effector protein mRNA and guide RNA can be administered together. Advantageously, a second booster dose of guide RNA can be administered 1-12 hours (preferably around 2-6 hours) after the initial administration of CRISPR effector protein mRNA+guide RNA.

The CRISPR effector protein of the present invention, e.g. a C2c2 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Additional administrations of CRISPR effector protein mRNA and/or guide RNA might be useful to achieve the most efficient levels of genome modification. In some embodiments, phenotypic alteration is preferably the result of genome modification when a genetic disease is targeted, especially in methods of therapy and preferably where a repair template is provided to correct or alter the phenotype.

In some embodiments diseases that may be targeted include those concerned with disease-causing splice defects.

In some embodiments, cellular targets include Hemopoietic Stem/Progenitor Cells (CD34+); Human T cells; and Eye (retinal cells)—for example photoreceptor precursor cells.

In some embodiments Gene targets include: Human Beta Globin—HBB (for treating Sickle Cell Anemia, including by stimulating gene-conversion (using closely related HBD gene as an endogenous template)); CD3 (T-Cells); and CEP920-retina (eye).

In some embodiments disease targets also include: cancer; Sickle Cell Anemia (based on a point mutation); HIV; Beta-Thalassemia; and ophthalmic or ocular disease—for example Leber Congenital Amaurosis (LCA)-causing Splice Defect.

In some embodiments delivery methods include: Cationic Lipid Mediated "direct" delivery of Enzyme-Guide complex (RiboNucleoProtein) and electroporation of plasmid DNA.

Inventive methods can further comprise delivery of templates, such as repair templates, which may be dsODN or ssODN, see below. Delivery of templates may be via the cotemporaneous or separate from delivery of any or all the CRISPR effector protein or guide and via the same delivery mechanism or different. In some embodiments, it is preferred that the template is delivered together with the guide, and, preferably, also the CRISPR effector protein. An example may be an AAV vector.

Inventive methods can further comprise: (a) delivering to the cell a double-stranded oligodeoxynucleotide (dsODN) comprising overhangs complimentary to the overhangs created by said double strand break, wherein said dsODN is integrated into the locus of interest; or —(b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said locus of interest. Inventive methods can be conducted in vivo in the individual or ex vivo on a cell taken from the individual, optionally wherein said cell is returned to the individual.

For minimization of toxicity and off-target effect, it will be important to control the concentration of CRISPR effector protein mRNA and guide RNA delivered. Optimal concentrations of CRISPR effector protein mRNA and guide RNA can be determined by testing different concentrations in a cellular or animal model and using deep sequencing the analyze the extent of modification at potential off-target genomic loci. For example, for the guide sequence targeting 5'-GAGTCCGAGCAGAAGAAGAA-3' (SEQ ID No. 165) in the EMXI gene of the human genome, deep sequencing can be used to assess the level of modification at the following two off-target loci, 1: 5'-GAGTCCTAGCAG-GAGAAGAA-3' (SEQ ID No. 166) and 2: 5'-GAGTCTAAGCAGAAGAAGAA-3' (SEQ ID No. 167). The concentration that gives the highest level of on-target modification while minimizing the level of off-target modification should be chosen for in vivo delivery.

Inducible Systems

In some embodiments, a CRISPR effector protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014018423 A2 which is hereby incorporated by reference in its entirety.
Modifying a Target with CRISPR Cas System or Complex (e.g., C2c2-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

In some embodiments, the method comprises allowing a CRISPR complex to bind to the target polynucleotide to effect cleavage of said target polynucleotide thereby modifying the target polynucleotide, wherein the CRISPR complex comprises a CRISPR effector protein complexed with a guide sequence hybridized or hybridizable to a target sequence within said target polynucleotide.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR effector protein complexed with a guide sequence hybridized or hybridizable to a target sequence within said polynucleotide. Similar considerations and conditions apply as above for methods of modifying a target polynucleotide. In fact, these sampling, culturing and re-introduction options apply across the aspects of the present invention.

Indeed, in any aspect of the invention, the CRISPR complex may comprise a CRISPR effector protein complexed with a guide sequence hybridized or hybridizable to a target sequence. Similar considerations and conditions apply as above for methods of modifying a target polynucleotide.

Thus in any of the non-naturally-occurring CRISPR effector proteins described herein comprise at least one modification and whereby the effector protein has certain improved capabilities. In particular, any of the effector proteins are capable of forming a CRISPR complex with a guide RNA. When such a complex forms, the guide RNA is capable of binding to a target polynucleotide sequence and the effector protein is capable of modifying a target locus. In addition, the effector protein in the CRISPR complex has reduced capability of modifying one or more off-target loci as compared to an unmodified enzyme/effector protein.

In addition, the modified CRISPR enzymes described herein encompass enzymes whereby in the CRISPR complex the effector protein has increased capability of modifying the one or more target loci as compared to an unmodified enzyme/effector protein. Such function may be provided separate to or provided in combination with the above-described function of reduced capability of modifying one or more off-target loci. Any such effector proteins may be provided with any of the further modifications to the CRISPR effector protein as described herein, such as in combination with any activity provided by one or more associated heterologous functional domains, any further mutations to reduce nuclease activity and the like.

In advantageous embodiments of the invention, the modified CRISPR effector protein is provided with reduced capability of modifying one or more off-target loci as compared to an unmodified enzyme/effector protein and increased capability of modifying the one or more target loci as compared to an unmodified enzyme/effector protein. In combination with further modifications to the effector protein, significantly enhanced specificity may be achieved. For example, combination of such advantageous embodiments with one or more additional mutations is provided wherein the one or more additional mutations are in one or more catalytically active domains. In such effector proteins, enhanced specificity may be achieved due to an improved specificity in terms of effector protein activity.

Additional functionalities which may be engineered into modified CRISPR effector proteins as described herein include the following. 1. modified CRISPR effector proteins that disrupt RNA: protein interactions without affecting protein tertiary or secondary structure. This includes residues that contact any part of the RNA: RNA duplex. 2. modified CRISPR effector proteins that weaken intra-protein interactions holding the CRISPR effector in conformation essential for nuclease cutting in response to RNA binding (on or off target). For example: a modification that mildly inhibits, but still allows, the nuclease conformation of the HNH domain (positioned at the scissile phosphate). 3. modified CRISPR effector proteins that strengthen intra-protein interactions holding the CRISPR effector in a conformation inhibiting nuclease activity in response to RNA binding (on or off targets). For example: a modification that stabilizes the HNH domain in a conformation away from the scissile phosphate. Any such additional functional enhancement may be provided in combination with any other modification to the CRISPR effector protein as described in detail elsewhere herein.

Any of the herein described improved functionalities may be made to any CRISPR effector protein, such as a C2c2 effector protein. However, it will be appreciated that any of the functionalities described herein may be engineered into CRISPR effector proteins from other orthologs, including chimeric effector proteins comprising fragments from multiple orthologs.

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992;

Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life-eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention the term "guide RNA", refers to the polynucleotide sequence comprising one or more of a putative or identified tracr sequence and a putative or identified crRNA sequence or guide sequence. In particular embodiments, the "guide RNA" comprises a putative or identified crRNA sequence or guide sequence. In further embodiments, the guide RNA does not comprise a putative or identified tracr sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However, it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible-reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p387). Examples of other software than may perform sequence comparisons include, but are not limited to, the BLAST package (see Ausubel et al., 1999 Short Protocols in Molecular Biology, 4th Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177 (1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), *Gene* 73 (1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9:745-756) (Taylor W. R. (1986) "The classification of amino acid conservation" *J. Theor. Biol.* 119; 205-218). Conservative substitutions may be made, for example according to Table 11 below which describes a generally accepted Venn diagram grouping of amino acids.

TABLE 11

| Set | | Sub-set | |
|---|---|---|---|
| Hydrophobic | F W Y H K M I L V A G C (SEQ ID No. 168) | Aromatic | F W Y H (SEQ ID No. 171) |
| | | Aliphatic | I L V |
| Polar | W Y H K R E D C S T N Q (SEQ ID No. 169) | Charged | H K R E D (SEQ ID No. 172) |
| | | Positively charged | H K R |
| | | Negatively charged | E D |
| Small | V C A G S P T N D (SEQ ID No. 170) | Tiny | A G S |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89 (20), 9367-9371 and Horwell D C, Trends Biotechnol. (1995) 13 (4), 132-134.

Homology modelling: Corresponding residues in other CRISPR orthologs can be identified by the methods of Zhang et al., 2012 (Nature; 490 (7421): 556-60) and Chen et al., 2015 (PLOS Comput Biol; 11 (5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22:359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR.

In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for guide RNA and wild type, modified or mutated CRISPR effector proteins/enzymes (e.g. C2c2). Bicistronic expression vectors guide RNA and wild type, modified or mutated CRISPR effector proteins/enzymes (e.g. C2c2) are preferred. In general and particularly in this embodiment and wild type, modified or mutated CRISPR effector proteins/enzymes (e.g. C2c2) is preferably driven by the CBh promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8 (1), p. 466-472, 1988); SV40 enhancer; and the intron sequence between exons 2 and 3 of rabbit β-globin (Proc. Natl. Acad. Sci. USA., Vol. 78 (3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67:31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces* cerivisae include pYepSec1 (Baldari, et al., 1987. *EMBO J.* 6:229-234), pMFa (Kuijan and Herskowitz, 1982. *Cell* 30:933-943), pJRY88 (Schultz et al., 1987. *Gene* 54:113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3:2156-2165) and the pVL series (Lucklow and Summers, 1989. *Virology* 170:31-39).

In some embodiments, a vector is capable of driving expression of one or more sequences in mammalian cells using a mammalian expression vector. Examples of mammalian expression vectors include pCDM8 (Seed, 1987. Nature 329:840) and pMT2PC (Kaufman, et al., 1987. EMBO J. 6:187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1:268-277), lymphoid-specific promoters (Calame and Eaton, 1988. Adv. Immunol. 43:235-275), in particular promoters of T cell receptors (Winoto and Baltimore, 1989. EMBO J. 8:729-733) and immunoglobulins (Baneiji, et al., 1983. Cell 33:729-740; Queen and Baltimore, 1983. Cell 33:741-748), neuron-specific promoters (e.g., the neurofilament promoter; Byrne and Ruddle, 1989. Proc. Natl. Acad. Sci. USA 86:5473-5477), pancreas-specific promoters (Edlund, et al., 1985. Science 230:912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249:374-379) and the α-fetoprotein promoter (Campes and Tilghman, 1989. Genes Dev. 3:537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in E. coli (Ishino et al., J. Bacteriol., 169:5429-5433 [1987]; and Nakata et al., J. Bacteriol., 171:3553-3556 [1989]), and associated genes. Similar interspersed SSRs have been identified in Haloferax mediterranei, Streptococcus pyogenes, Anabaena, and Mycobacterium tuberculosis (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema, and Thermotoga.

In general, "nucleic acid-targeting system" as used in the present application refers collectively to transcripts and other elements involved in the expression of or directing the activity of nucleic acid-targeting CRISPR-associated ("Cas") genes (also referred to herein as an effector protein), including sequences encoding a nucleic acid-targeting Cas (effector) protein and a guide RNA (comprising crRNA sequence and a trans-activating CRISPR/Cas system RNA (tracrRNA) sequence), or other sequences and transcripts from a nucleic acid-targeting CRISPR locus. In some embodiments, one or more elements of a nucleic acid-targeting system are derived from a Type V/Type VI nucleic acid-targeting CRISPR system. In some embodiments, one or more elements of a nucleic acid-targeting system is derived from a particular organism comprising an endogenous nucleic acid-targeting CRISPR system. In general, a nucleic acid-targeting system is characterized by elements that promote the formation of a nucleic acid-targeting complex at the site of a target sequence. In the context of formation of a nucleic acid-targeting complex, "target sequence" refers to a sequence to which a guide sequence is designed to have complementarity, where hybridization between a target sequence and a guide RNA promotes the formation of a DNA or RNA-targeting complex. Full complementarity is not necessarily required, provided there is sufficient complementarity to cause hybridization and promote formation of a nucleic acid-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

Typically, in the context of an endogenous nucleic acid-targeting system, formation of a nucleic acid-targeting complex (comprising a guide RNA hybridized to a target sequence and complexed with one or more nucleic acid-targeting effector proteins) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and a guide RNA embedded within one or more intron sequences (e.g. each in a different intron, two or more in at least one intron, or all in a single intron). In some embodiments, the nucleic acid-targeting effector protein and guide RNA are operably linked to and expressed from the same promoter.

In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a nucleic acid-targeting complex to a target sequence may be assessed by any suitable assay. For example, the components of a nucleic acid-targeting system sufficient to form a nucleic acid-targeting complex, including the guide sequence to be tested, may be provided to a host cell having the corresponding target sequence, such as by transfection with vectors encoding the components of the nucleic acid-targeting CRISPR sequence, followed by an assessment of preferential cleavage within or in the vicinity of the target sequence, such as by Surveyor assay as described herein. Similarly, cleavage of a target polynucleotide sequence (or a sequence in the vicinity thereof) may be evaluated in a test tube by providing the target sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art.

A guide sequence may be selected to target any target sequence. In some embodiments, the target sequence is a sequence within a gene transcript or mRNA.

In some embodiments, the target sequence is a sequence within a genome of a cell.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106 (1): 23-24; and P A Carr and G M Church, 2009, *Nature Biotechnology* 27 (12): 1151-62). Further algorithms may be found in U.S. application Ser. No. 61/836,080; incorporated herein by reference.

In some embodiments, the nucleic acid-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR effector protein/enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR effector protein/enzyme fusion protein may comprise any additional protein sequence, and optionally a linker sequence between any two domains. Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence.

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a nucleic acid-targeting effector protein in combination with (and optionally complexed with) a guide RNA is delivered to a cell. Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6 (10): 1149-1154 (1988); Vigne, Restorative Neurology and Neuroscience 8:35-36 (1995); Kremer & Perricaudet, British Medical Bulletin 51 (1): 31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid: nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat.

No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Functional Alteration

The use of the CRISPR system of the present invention to precisely deliver functional domains, to activate or repress genes or to alter epigenetic state by precisely altering the methylation site on a a specific locus of interest, can be with one or more guide RNAs applied to a single cell or population of cells or with a library applied to genome in a pool of cells ex vivo or in vivo comprising the administration or expression of a library comprising a plurality of guide RNAs (sgRNAs) and wherein wherein the CRISPR complex comprising the CRISPR effector protein is modified to comprise a heterologous functional domain. In an aspect the invention provides a method for screening a genome/transcriptome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a CRISPR effector protein. In an aspect the invention provides a method as herein discussed wherein the activator is attached to the N terminus or the C terminus of the CRISPR effector protein. In an aspect the invention provides a method as herein discussed wherein the activator is attached to a sgRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by CRISPR effector protein and minimizes off-target cleavage by the CRISPR effector protein. In an aspect, the invention provides guide specific binding of CRISPR effector protein at a gene locus without DNA cleavage. Accordingly, in an aspect, the invention provides target-specific gene regulation. In an aspect, the invention provides guide specific binding of CRISPR effector protein at a gene locus without DNA cleavage. Accordingly, in an aspect, the invention provides for cleavage at one locus and gene regulation at a different locus using a single CRISPR effector protein. In an aspect, the invention provides orthogonal activation and/or inhibition and/or cleavage of multiple targets using one or more CRISPR effector protein and/or enzyme.

In an aspect the invention provides a method as herein discussed, wherein the host is a eukaryotic cell. In an aspect the invention provides a method as herein discussed, wherein the host is a mammalian cell. In an aspect the invention provides a method as herein discussed, wherein the host is a non-human eukaryote. In an aspect the invention provides a method as herein discussed, wherein the non-human eukaryote is a non-human mammal. In an aspect the invention provides a method as herein discussed, wherein the non-human mammal is a mouse. An aspect the invention provides a method as herein discussed comprising the delivery of the CRISPR effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a lentivirus, an adenovirus, or an AAV. In an aspect the invention provides a method as herein discussed wherein the delivery is via a particle, a nanoparticle, a lipid or a cell penetrating peptide (CPP).

In an aspect the invention provides a pair of CRISPR complexes comprising CRISPR effector protein, each comprising a guide RNA (sgRNA) comprising a guide sequence capable of hybridizing to a target sequence in a genomic locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each CRISPR effector protein complex comprises a functional domain having a DNA cleavage activity.

In an aspect the invention provides a method for cutting a target sequence in a locus of interest comprising delivery to a cell of the CRISPR effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein-discussed wherein the delivery is via a lentivirus, an adenovirus, or an AAV.

In an aspect the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA molecule encoding the gene product an engineered, non-naturally occurring CRISPR system comprising a CRISPR effector protein and guide RNA that targets the RNA molecule, whereby the guide RNA targets the RNA target molecule encoding the gene product and the CRISPR effector protein cleaves the RNA molecule encoding the gene product, whereby expression of the gene product is altered; and, wherein the CRISPR effector protein and the guide RNA do not naturally occur together. The invention comprehends the guide RNA comprising a guide sequence linked to a direct repeat sequence. The invention further comprehends the CRISPR effector protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In some embodiments, one or more functional domains are associated with the CRISPR effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with a dead sgRNA (dRNA). In some embodiments, a dRNA complex with active CRISPR effector protein directs gene regulation by a functional domain at on gene locus while an sgRNA directs DNA cleavage by the active CRISPR effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage In certain embodiments, the (heterologous) functional domain is a translational repressor.

For the purposes of the following discussion, reference to a functional domain could be a functional domain associated with the CRISPR effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising translation activation activity, translation repression activity, methylase activity, demethylase activity, transcription activation activity, transcription repression activity, transcription release factor activity, histone modification activity, RNA cleavage activity, DNA cleavage activity, DNA integration activity or nucleic acid binding activity.

In some embodiments, the DNA cleavage activity is due to a nuclease. In some embodiments, the nuclease comprises a FokI nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32 (6): 569-77 (2014), relates to dimeric RNA-guided FokI Nucleases that recognize extended sequences and can edit endogenous genes with high efficiencies in human cells.

In some embodiments, the one or more functional domains is attached to the CRISPR effector protein so that upon binding to the sgRNA and target the functional domain is in a spatial orientation allowing for the functional domain to function in its attributed function.

In some embodiments, the one or more functional domains is attached to the adaptor protein so that upon binding of the CRISPR effector protein to the sgRNA and target, the functional domain is in a spatial orientation allowing for the functional domain to function in its attributed function.

In an aspect the invention provides a composition as herein discussed wherein the one or more functional domains is attached to the CRISPR effector protein or adaptor protein via a linker, optionally a GlySer linker, as discussed herein.

It is also preferred to target endogenous (regulatory) control elements, such as involved in translation, stability, etc. Targeting of known control elements can be used to activate or repress the gene of interest. Targeting of putative control elements on the other hand can be used as a means to verify such elements (by measuring the translation of the gene of interest) or to detect novel control elements (In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a CRISPR effector protein as described herein, preferably a dead-CRISPR effector protein, more preferably a dead-FnCRISPR effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6th April 2015).

In some preferred embodiments, the functional domain is linked to a dead-CRISPR effector protein to target and activate epigenomic sequences such as promoters or enhancers. One or more guides directed to such promoters or enhancers may also be provided to direct the binding of the CRISPR enzyme to such promoters or enhancers.

In certain embodiments, the RNA targeting effector protein of the invention can be used to interfere with co-transcriptional modifications of DNA/chromatin structure, RNA-directed DNA methylation, or RNA-directed silencing/activation of DNA/chromatin. RNA-directed DNA methylation (RdDM) is an epigenetic process first discovered in plants. During RdDM, double-stranded RNAs (dsRNAs) are processed to 21-24 nucleotide small interfering RNAs (siRNAs) and guide methylation of homologous DNA loci. Besides RNA molecules, a plethora of proteins are involved in the establishment of RdDM, like Argonautes, DNA methyltransferases, chromatin remodelling complexes and the plant-specific PolIV and PolV. All these act in concert to add a methyl-group at 5' position of cytosines. Small RNAs can modify the chromatin structure and silence transcription by guiding Argonaute-containing complexes to complementary nascent (non-coding) RNA trancripts. Subsequently the recruitment of chromatin-modifying complexes, including histone and DNA methyltransferases, is mediated. The RNA targeting effector protein of the invention may be used to target such small RNAs and interfere in interactions between these small RNAs and the nascent non-coding transcripts.

The term "associated with" is used here in relation to the association of the functional domain to the CRISPR effector protein or the adaptor protein. It is used in respect of how one molecule 'associates' with respect to another, for example between an adaptor protein and a functional domain, or between the CRISPR effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the CRISPR effector protein or adaptor protein is associated with a functional domain by binding thereto. In other embodiments, the CRISPR effector protein or adaptor protein is associated with a functional domain because the two are fused together, optionally via an intermediate linker.

CRISPR Effector Protein Complexes can be Used in Plants

The CRISPR effector protein system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The CRISPR effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described CRISPR effector protein systems may be analogous to the use of the CRISPR-Cas (e.g. CRISPR-Cas9) system in plants, and mention is made of the University of Arizona website "CRISPR-PLANT" (genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6 (6): 1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at newphytologist.com); Caliando et al, "Targeted DNA degradation using a CRISPR device stably carried in the host st genome, NATURE COMMUNICATIONS 6:6989, DOI: 10.1038/ncomms7989, nature.com/naturecommunications DOI: 10.1038/ncomms7989; U.S. Pat. No. 6,603,061—*Agrobacterium*-Mediated Plant Transformation Method; U.S. Pat. No. 7,868,149—Plant Genome Sequences and Uses Thereof and US 2009/0100536-Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13 (2): 85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applciations, including those mentioned herein.

In an aspect, the RNA targeting effector protein of the invention can be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Sugano et al. (Plant Cell Physiol. 2014 March; 55 (3): 475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of TI plants. Multiple arf1 alleles were easily established using CRIPSR/Cas9-based targeted mutagenesis. The CRISPR systems of the present invention can be used to regulate the same as well as other genes, and like expression control system such as RNAi and siRNA, the method of the invention can be inducible and reversible.

Kabadi et al. (Nucleic Acids Res. 2014 Oct. 29; 42 (19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The instant invention can be used to regulate the plant genes of Kabadi.

Xing et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA) module vector set, as a toolkit for multiplex genome editing in plants. The CRISPR systems and proteins of the instant invention may be used to target the genes targeted by Xing.

The CRISPR systems of the invention may be used in the treatment, prevention, suppression, and/or alleviation of of plant virus pathogenesis, replication, proparation, viremia, viral load or titer and/or infection. Gambino et al. (Phytopathology. 2006 November; 96 (11): 1223-9. doi: 10.1094/PHYTO-96-1223) relied on amplification and multiplex PCR for simultaneous detection of nine grapevine viruses. The CRISPR systems and proteins of the instant invention may similarly be used to detect multiple targets in a host. Moreover, the systems of the invention can be used to simultaneously knock down viral gene expression in valuable cultivars, and prevent activation or further infection by targeting expressed vial RNA.

Murray et al. (Proc Biol Sci. 2013 Jun. 26; 280 (1765): 20130965. doi: 10.1098/rspb.2013.0965; published 2013 Aug. 22) analyzxed 12 plant RNA viruses to investigatge evoluationary rates and found evidence of episodic selection possibly due to shifts between different host genotyopes or species. The CRISPR systems and proteins of the instant invention may be used to tarteg or immunize against such viruses in a host. For example, the systems of the invention can be used to block viral RNA expression hence replication. Also, the invention can be used to target nuclic acids for cleavage as wll as to target expression or activation. Moreover, the systems of the invention can be multiplexed so as to hit multiple targets or multiple isolate of the same virus.

Ma et al. (Mol Plant. 2015 Aug. 3; 8 (8): 1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and TlArabidopsis plants by simultaneous targeting of multiple (up to eight) members of a gene family, multiple genes in a biosynthetic pathway, or multiple sites in a single gene. Similarly, the CRISPR systems of the instant invention can dffieicnelty target expression of multiple genes simultaneously.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, we developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the CRISPR effector protein system of the present invention.

Organisms such as yeast and microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2μ-based vector locations. The authors also showed that gene disruption efficiency could be improved by optimization of the levels of Cas9 and gRNA expression. Hlavová et al. (Biotechnol. Adv. 2015) discusses development of species or strains of microalgae using techniques such as CRISPR to target nuclear and chloroplast genes for insertional mutagenesis and screening. The same plasmids and vectors can be applied to the CRISPR systems of the instant invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the CRISPR effector protein system of the present invention.

Kurthe t al, J Virol. 2012 June; 86 (11): 6002-9. doi: 10.1128/JVI.00436-12. Epub 2012 Mar. 21) developed an RNA virus-based vector for the introduction of desired traits into grapevine without heritable modifications to the genome. The vector provided the ability to regulate expression of of endogenous genes by virus-induced gene silencing. The CRISPR systems and proteins of the instant invention can be used to silence genes and proteins without heritable modification to the genome.

In an embodiment, the plant may be a legume. The present invention may utilize the herein disclosed CRISP-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in Medicago. The CRISPR systems and proteins of the instant invention can be used to knockout/knockdown systems.

Peanut allergies and allergies to legumes generally are a real and serious health concern. The CRISPR effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11 (3): 222).

In an advantageous embodiment, the plant may be a tree. The present invention may also utilize the herein disclosed CRISPR Cas system for herbaceous systems (see, e.g., Belhaj et al., Plant Methods 9:39 and Harrison et al., Genes & Development 28:1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate: CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the CRISPR effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula*×*alba* clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the Medicago U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the CRISPR effector protein system of the present invention.

In plants, pathogens are often host-specific. For example, *Fusarium oxysporum* f. sp. *lycopersici* causes tomato wilt but attacks only tomato, and *F. oxysporum* f. *dianthii* Puccinia graminis f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213, 991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105, 035), US 2014-0186958 (U.S. application Ser. No. 14/105, 017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162

B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014 Jun. 10, 2014; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, DEAD GUIDES FOR CRISPR TRANSCRIPTION FACTORS; U.S. application 62/091,456, 12 Dec. 2014, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, RNA-TARGETING SYSTEM; U.S. application 62/096,656, 24 Dec. 2014, CRISPR HAVING OR ASSOCIATED WITH DESTABILIZATION DOMAINS; U.S. application 62/096,697, 24 Dec. 2014, CRISPR HAVING OR ASSOCIATED WITH AAV; US application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 2014, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini L. A., & Zhang, F. Science February 15; 339 (6121): 819-23 (2013);

RNA-guided editing of bacterial genomes using CRISPR-Cas systems. Jiang W., Bikard D., Cox D., Zhang F, Marraffini L A. Nat Biotechnol March; 31 (3): 233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153 (4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500 (7463): 472-6. doi: 10.1038/Nature12466. Epub 2013 Aug. 23 (2013);

Double Nicking by RNA-Guided CRISPR Cas9 for Enhanced Genome Editing Specificity. Ran, FA., Hsu, PD., Lin, CY., Gootenberg, JS., Konermann, S., Trevino, AE., Scott, DA., Inoue, A., Matoba, S., Zhang, Y., & Zhang, F. Cell August 28. pii: S0092-8674 (13)01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, LA., Bao, G., & Zhang, F. Nat Biotechnol doi:10.1038/nbt.2647 (2013);

Genome engineering using the CRISPR-Cas9 system. Ran, FA., Hsu, PD., Wright, J., Agarwala, V., Scott, DA., Zhang, F. Nature Protocols November; 8 (11): 2281-308 (2013-B);

Genome-Scale CRISPR-Cas9 Knockout Screening in Human Cells. Shalem, O., Sanjana, NE., Hartenian, E., Shi, X., Scott, DA., Mikkelson, T., Heckl, D., Ebert, BL., Root, DE., Doench, JG., Zhang, F. Science December 12. (2013). [Epub ahead of print];

Crystal structure of cas9 in complex with guide RNA and target DNA. Nishimasu, H., Ran, FA., Hsu, PD., Konermann, S., Shehata, SI., Dohmae, N., Ishitani, R., Zhang, F., Nureki, O. Cell February 27, 156 (5): 935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159 (2): 440-455 DOI: 10.1016/j.cell.2014.09.014 (2014);

Development and Applications of CRISPR-Cas9 for Genome Engineering, Hsu P D, Lander E S, Zhang F., Cell. June 5; 157 (6): 1262-78 (2014).

Genetic screens in human cells using the CRISPR/Cas9 system, Wang T, Wei J J, Sabatini D M, Lander E S., Science. January 3; 343 (6166): 80-84. doi:10.1126/science. 1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32 (12): 1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33 (1): 102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517 (7536): 583-8 (2015).

A split-Cas9 architecture for inducible genome editing and transcription modulation, Zetsche B, Volz S E, Zhang F., (published online 2 Feb. 2015) Nat Biotechnol. Febuary; 33 (2): 139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260 Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520 (7546): 186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015)>Nishimasu et al., "Crystal Structure of *Staphylococcus aureus* Cas9," Cell 162, 1113-1126 (Aug. 27, 2015)

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015

Shmakov et al. (2015), "Discovery and Functional Characterization of Diverse Class 2 CRISPR-Cas Systems," Molecular Cell 60, 385-397 (Nov. 5, 2015) doi: 10.1016/j.molcel.2015.10.008. Epub Oct. 22, 2015

Gao et al, "Engineered Cpf1 Enzymes with Altered PAM Specificities," bioRxiv 091611; doi: dx.doi.org/10.1101/091611 Epub Dec. 4, 2016 each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA: Cas9-directed cleavage at the targeted genomic site to kill unmutated cells and circumvents the need for selectable markers or counter-selection systems. The study reported reprogramming dual-RNA: Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293 FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA: DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Zetsche et al. (2015) reported the characterization of Cpf1, a putative class 2 CRISPR effector. It was demonstrated that Cpf1 mediates robust DNA interference with features distinct from Cas9. Identifying this mechanism of interference broadens our understanding of CRISPR-Cas systems and advances their genome editing applications.

Shmakov et al. (2015) reported the characterization of three distinct Class 2 CRISPR-Cas systems. The effectors of two of the identified systems, C2c1 and C2c3, contain RuvC like endonuclease domains distantly related to Cpf1. The third system, C2c2, contains an effector with two predicted HEPN RNase domains.

Gao et al. (2016) reported using a structure-guided saturation mutagenesis screen to increase the targeting range of Cpf1. AsCpf1 variants were engineered with the mutations S542R/K607R and S542R/K548V/N552R that can cleave target sites with TYCV/CCCC and TATV PAMs, respectively, with enhanced activities in vitro and in human cells.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32 (6): 569-77 (2014), relates to dimeric RNA-guided FokI Nucleases that recognize extended sequences and can edit endogenous genes with high efficiencies in human cells.

In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30 C, e.g., 20-25 C, e.g., room temperature, for a suitable time, e.g., 15-45, such as 30 minutes, advantageously in sterile, nuclease free buffer, e.g., 1X PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a C1-6 alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

Viral Detection, Monitoring, and Diagnosis

Treating and surveilling viral infections remains a scientific challenge. In the past 50 years, the world has produced 90 clinically approved antiviral drugs, but these drugs are only treat 9 viral diseases, less than 10% of the 130 viruses known to be human pathogens (2). Vaccines have emerged as the predominant approach to combating viral diseases, but only 16 viruses are covered by FDA-approved vaccines. Viral nucleic acid diagnostics are equally sparse, as only 11 viruses currently have an FDA-approved nucleic acid diagnostic. Thus, there remains a pressing need both to detect viruses and to develop novel antiviral therapies, especially in light of recent major outbreaks across the globe.

Viral evolution exacerbates the challenges already associated with antiviral therapy and viral detection. Antiviral therapy drives selection leading to resistant viral genomes, and mutations in the viral genome can decrease the sensitivity of nucleic acid diagnostics. To counteract viral evolution, we need to better understand the process by which antiviral therapy resistance evolves. Concomitantly, we need therapeutic approaches that can be easily adapted if a virus evolves resistance, paired with diagnostics to detect resistance mutations which could emerge over time.

In certain aspects of the invention, a sequence-specific nuclease, such as a CRISPR effector protein, has the potential to solve these therapeutic and diagnostic challenges. CRISPR-based technologies have revolutionized many areas of biology, including genome editing, high-throughput screening, and chromosome imaging.

The sequence-specific nature of CRISPR/Cas system cleavage naturally lends itself to therapeutic and diagnostic applications. The present inventors have found that Cas13 is able to target the RNA of Lymphocytic choriomeningitis virus (LCMV), a genetic relative of Lassa virus which infects tens of thousands of West Africans annually, thereby inhibiting its replication. In addition to therapy, Cas13 is uniquely poised for viral detection using the recently published Specific High sensitivity Enzymatic Reporter unlocking (SHERLOCK) platform (Grootenberg et al. (2017), "Nucleic acid detection with CRISPR-Cas13/C2c2", Science, 356 (6336): 438-442). SHERLOCK can detect RNA with single molecule sensitivity and has the specificity to identify single nucleotide polymorphisms.

In order to realize the potential of Cas13-based therapeutics and diagnostics, we must uncover mechanisms surrounding Cas13 cleavage and viral evolution. An important scientific question is how target RNA sequence, secondary structure, and gene function influence Cas13-mediated inhibition of viral replication. Secondarily, viruses rapidly generate mutations, allowing them to escape many antiviral selective pressures, possibly including Cas13 targeting.

In certain aspects, the present invention relates to a Class 2, type VI CRISPR system-based detection and therapeutic technologies, such as Cas13-based detection and therapeutic technologies to understand and counteract the evolution of viruses that can cause infectious outbreaks, such as in humans. In certain aspects, the invention relates to methods for determining how viral genomes evolve in response to Class 2, type VI CRISPR system, such as Cas13, targeting. In certain aspects, the invention relates to methods for preventing guide RNA targeting resistance from evolving, such as by using multiplexed therapies. In certain aspects, the invention relates to methods for rapidly identifying viral pathogens and/or determining if they have acquired any undesired mutations.

In one aspect, the invention provides a nucleic acid detection system (suitable for the detection or diagnostic methods as described herein elsewhere, such as suitable for a companion or complementary diagnostic method according to certain aspects of the invention as described herein) comprising: a CRISPR system comprising an effector protein and one or more guide RNAs designed to bind to corresponding target molecules; a RNA-based masking construct; and optionally, nucleic acid amplification reagents to amplify target RNA molecules in a sample. In another aspect, the embodiments provide a polypeptide detection system comprising: a CRISPR system comprising an effector protein and one or more guide RNAs designed to bind a trigger RNA, a RNA-based masking construct; and one or more detection aptamers comprising a masked RNA polymerase promoter binding site or a masked primer binding site. An exemplary method is for example described in Grootenberg et al. (2017), "Nucleic acid detection with CRISPR-Cas13/C2c2", Science, 356 (6336): 438-442, incorporated herein by reference in its entirety.

As used herein, a "companion diagnostic" or "companion diagnostic method" refers to a diagnostic test used as a companion to a therapeutic drug to determine its applicability to a specific person. Companion diagnostics are typically co-developed with drugs to aid in selecting or excluding patient groups for treatment with that particular drug on the basis of their biological characteristics that determine responders and non-responders to the therapy. A companion diagnostic may be a medical device, often an in vitro device, which provides information that is preferably essential for the safe and effective use of a corresponding drug or biological product. The test helps a health care professional determine whether a particular therapeutic product's benefits to patients will outweigh any potential serious side effects or risks. Companion diagnostics can for instance identify patients who are most likely to benefit from a particular therapeutic product; identify patients likely to be at increased risk for serious side effects as a result of treatment with a particular therapeutic product; or monitor response to treatment with a particular therapeutic product for the purpose of adjusting treatment to achieve improved safety or effectiveness.

In further embodiments, the system may further comprise nucleic acid amplification reagents. The nucleic acid amplification reagents may comprise a primer comprising an RNA polymerase promoter. In certain embodiments, sample nucleic acids are amplified to obtain a DNA template comprising an RNA polymerase promoter, whereby a target RNA molecule may be generated by transcription. The nucleic acid may be DNA and amplified by any method described herein. The nucleic acid may be RNA and amplified by a reverse transcription method as described herein. The aptamer sequence may be amplified upon unmasking of the primer binding site, whereby a trigger RNA is transcribed from the amplified DNA product. The target molecule may be a target DNA and the system may further comprises a primer that binds the target DNA and comprises a RNA polymerase promoter.

In another embodiment, the one or more guide RNAs are designed to detect a single nucleotide polymorphism, splice variant of a transcript, or a frameshift mutation in a target RNA or DNA.

In other embodiments, the one or more guide RNAs are designed to bind to one or more target molecules that are diagnostic for a (viral) disease or disease state/grade.

In other embodiments of the invention, the RNA-based masking construct suppresses generation of a detectable positive signal or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In further embodiments, the RNA-based masking construct is a ribozyme that generates the negative detectable signal, and wherein the positive detectable signal is generated when the ribozyme is deactivated, or the ribozyme converts a substrate to a first color and wherein the substrate converts to a second color when the ribozyme is deactivated.

In other embodiments, the RNA-based masking agent is a RNA aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal.

In another embodiment, the RNA-based masking construct comprises a RNA oligonucleotide to which a detectable ligand and a masking component are attached. In another embodiment, the detectable ligand is a fluorophore and the masking component is a quencher molecule, or the reagents to amplify target RNA molecules such as, but not limited to, NASBA or RPA reagents.

In another aspect, the invention provides a diagnostic device comprising one or more individual discrete volumes, each individual discrete volumes comprising a CRISPR effector protein, one or more guide RNAs designed to bind to corresponding target molecule, a RNA-based masking construct, and optionally further comprise nucleic acid amplification reagents.

In another aspect, the invention provides a diagnostic device comprising one or more individual discrete volumes, each individual discrete volume comprising a CRISPR effector protein, one or more guide RNAs designed to bind to a trigger RNA, one or more detection aptamers comprising a masked RNA polymerase promoter binding site or a masked primer binding site, and optionally further comprising nucleic acid amplification reagents.

In some embodiments, the individual discrete volumes are droplets, or the individual discrete volumes are defined on a solid substrate, or the individual discrete volumes are microwells, or the individual discrete volumes are spots defined on a substrate, such as a paper substrate.

In another aspect, the invention provides a method for detecting target RNAs in samples, comprising: distributing a sample or set of samples into one or more individual discrete volumes, the individual discrete volumes comprising a CRISPR system comprising an effector protein, one or more guide RNAs, a RNA-based masking construct; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is produced; and detecting the detectable positive signal, wherein detection of the detectable positive signal indicates a presence of one or more target molecules in the sample.

In another aspect, the invention provides a method for detecting peptides in samples, comprising: distributing a sample or set of samples into a set of individual discrete volumes, the individual discrete volumes comprising peptide detection aptamers, a CRISPR system comprising an effector protein, one or more guide RNAs, a RNA-based masking construct, wherein the peptide detection aptamers comprising a masked RNA polymerase site and configured to bind one or more target molecules; incubating the sample or set of samples under conditions sufficient to allow binding of the peptide detection aptamers to the one or more target molecules, wherein binding of the aptamer to a corresponding target molecule exposes the RNA polymerase binding site resulting in RNA synthesis of a trigger RNA; activating the CRISPR effector protein via binding of the one or more guide RNAs to the trigger RNA, wherein activating the CRISPR effector protein results in modification of the RNA-based masking construct such that a detectable positive signal is produced; and detecting the detectable positive signal, wherein detection of the detectable positive signal indicates a presence of one or more target molecules in a sample.

In certain example embodiments, such methods further comprise amplifying the sample RNA or the trigger RNA. In other embodiments, amplifying RNA comprises amplification by NASBA or RPA.

The low cost and adaptability of the assay platform lends itself to a number of applications including (i) general RNA/DNA/protein quantitation, (ii) rapid, multiplexed RNA/DNA and protein expression detection, and (iii) sensitive detection of target nucleic acids, peptides, and proteins in both clinical and environmental samples. Additionally, the systems disclosed herein may be adapted for detection of transcripts within biological settings, such as cells. Given the highly specific nature of the CRISPR effectors described herein, it may possible to track allelic specific expression of transcripts or disease-associated mutations in live cells.

In certain example embodiments, a single guide RNA specific to a single target is placed in separate volumes. Each volume may then receive a different sample or aliquot of the same sample. In certain example embodiments, multiple guide RNA each to separate target may be placed in a single well such that multiple targets may be screened in a different well. In order to detect multiple guide RNAs in a single volume, in certain example embodiments, multiple effector proteins with different specificities may be used. For example, different orthologs with different sequence specificities may be used. For example, one orthologue may preferentially cut A, while others preferentially cut C, U, or T. Accordingly, guide RNAs that are all, or comprise a substantial portion, of a single nucleotide may be generated, each with a different fluorophore. In this way up to four different targets may be screened in a single individual discrete volume.

In certain aspects, the present invention relates to personalized medicine. In particular, the provision of a companion diagnostic tool as described herein allows to tailor therapy, such as to overcome, circumvent, or prevent viral resistance, or to specifically target particular viral species, or strains which are prevalent in certain conditions, such as associated with particular geographic regions or particular viral outbreaks (or stages of the outbreak).

It will be understood that the CRISPR/Cas system based detection methods described herein are non-limiting examples of suitable detection/diagnostic systems.

In certain example embodiments, the systems, devices, and methods, disclosed herein are directed to detecting the presence of one or more viral agents in a sample, such as a biological sample obtained from a subject. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g. bacterial resistance), monitoring of disease progression and/or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used guide therapeutic regimens, such as selection of the appropriate antibiotic or antiviral. The embodiments disclosed herein may also be used to screen environmental samples (air, water, surfaces, food etc.) for the presence of microbial contamination.

Particular embodiments disclosed herein describe methods and systems that will identify and distinguish viral species within a single sample, or across multiple samples, allowing for recognition of many different viruses. The present methods allow the detection of pathogens and distinguishing between two or more species of one or more virus or a combination thereof, in a biological or environmental sample, by detecting the presence of a target nucleic acid sequence in the sample. A positive signal obtained from the sample indicates the presence of the virus. Multiple viruses can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once. In some embodiments, simultaneous detection of multiple viruses may be performed using a set of probes that can identify one or more viral species.

Multiplex analysis of samples enables large-scale detection of samples, reducing the time and cost of analyses. However, multiplex analyses are often limited by the availability of a biological sample. In accordance with the invention, however, alternatives to multiplex analysis may be performed such that multiple effector proteins can be added to a single sample and each masking construct may be combined with a separate quencher dye. In this case, positive signals may be obtained from each quencher dye separately for multiple detection in a single sample.

Disclosed herein are methods for distinguishing between two or more species of one or more virus in a sample. The methods are also amenable to detecting one or more species of one or more virus in a sample.

Viral Detection

In some embodiments, a method for detecting viruses in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or RNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. If DNA method may further comprise the use of DNA primers that introduce a RNA polymerase promoter as described herein. If the target is a protein than the method will utilized aptamers and steps specific to protein detection described herein.

Detection of Single Nucleotide Variants

In some embodiments, one or more identified target sequences may be detected using as a non-limiting example guide RNAs that are specific for and bind to the target sequence as described herein. The systems and methods of the present invention can distinguish even between single nucleotide polymorphisms present among different viral species and therefore, use of multiple guide RNAs in accordance with the invention may further expand on or improve the number of target sequences that may be used to distinguish between species. For example, in some embodiments, the one or more guide RNAs may distinguish between viruses at the species, genus, family, order, class, phylum, kingdom, or phenotype, or a combination thereof.

Screening for Drug Resistance

In certain example embodiments, the devices, systems and methods disclosed herein may be used to screen for viral genes of interest, for example antibiotic and/or antiviral resistance genes. As a non-limiting example, guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regime.

Ribavirin is an effective antiviral that hits a number of RNA viruses. Several clinically important viruses have evolved ribavirin resitance including Foot and Mouth Disease Virus doi:10.1128/JVI.03594-13; polio virus (Pfeifer and Kirkegaard. PNAS, 100 (12): 7289-7294, 2003); and hepatitis C virus (Pfeiffer and Kirkegaard, J. Virol. 79 (4): 2346-2355, 2005). A number of other persistant RNA viruses, such as hepatitis and HIV, have evolved resitance to existing antiviral drugs: hepatitis B virus (lamivudine, tenofovir, entecavir) doi:10/1002/hep22900; hepatits C virus (telaprevir, BILN2061, ITMN-191, SCh6, boceprevir, AG-021541, ACH-806) doi:10.1002/hep.22549; and HIV (many drug resistance mutations) hivb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi:10.1073/pnas.1019304108), and increased infectivity of Ebola (Diehl et al. Cell. 2016, 167 (4): 1088-1098.

As described herein elsewhere, closely related viral species (e.g. having only a single nucleotide difference in a given target sequence) may be distinguished by introduction of a synthetic mismatch in the gRNA, as described herein elsewhere.

Set Cover Approaches

In particular embodiments, all viral species within a defined set of viruses can be identified.

The ability to detect multiple transcript abundances may allow for the generation of unique viral signatures indicative of a particular phenotype. Various machine learning techniques may be used to derive the gene signatures. Accordingly, for instance the guide RNAs of the CRISPR systems may be used to identify and/or quantitate relative levels of biomarkers defined by the gene signature in order to detect certain phenotypes. In certain example embodiments, the gene signature indicates susceptibility to an antibiotic, resistance to an antibiotic, or a combination thereof.

In one aspect of the invention, a method comprises detecting one or more virus. In this manner, differentiation between infection of a subject by individual viruses may be obtained. In some embodiments, such differentiation may enable detection or diagnosis by a clinician of specific diseases, for example, different variants of a disease. Preferably the viral sequence is a genome of the pathogen or a fragment thereof. The method further may comprise determining the evolution of the virus. Determining the evolution of the virus may comprise identification of viral mutations, e.g. nucleotide deletion, nucleotide insertion, nucleotide substitution. Amongst the latter, there are non-synonymous, synonymous, and noncoding substitutions. Mutations are more frequently non-synonymous during an outbreak. The method may further comprise determining the substitution rate between two viral sequences analyzed as described above. Whether the mutations are deleterious or even adaptive would require functional analysis, however, the rate of non-synonymous mutations suggests that continued progression of this epidemic could afford an opportunity for pathogen adaptation, underscoring the need for rapid containment. Thus, the method may further comprise assessing the risk of viral adaptation, wherein the number non-synonymous mutations is determined. (Gire, et al., *Science* 345, 1369, 2014).

Monitoring Viral Outbreaks

In some embodiments, the methods as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak increases likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subject (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., *Cell* 161 (7): 1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence, and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence. (Park, et al., 2015).

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of 8×10-4 per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leon might stem from the introduction of two genetically distinct viruses from Guinea around the same time (Gire, et al., 2014).

It has been also possible to determine how the Lassa virus spread out from its origin point, in particular thanks to human-to-human transmission and even retrace the history of this spread 400 years back (Andersen, et al., *Cell* 162 (4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may used any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnostics can be performed, thus diminishing the risk of administering the wrong treatment to the patient.

In other cases, a disease such as a viral infection may occur without any symptoms, or had caused symptoms but they faded out before the patient is presented to the medical staff. In such cases, either the patient does not seek any medical assistance or the diagnostics is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples (see, e.g., US patent publication No.).

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission links.

Sample Types

Appropriate samples for use in the methods disclosed herein include any conventional biological sample obtained from an organism or a part thereof, such as a plant, animal, bacteria, and the like. In particular embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms (such as plants or animals, including samples from a healthy or apparently healthy human subject or a human patient affected by a condition or disease to be diagnosed or investigated, such as an infection with a pathogenic microorganism, such as a pathogenic bacteria or virus). For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

A sample can also be a sample obtained from any organ or tissue (including a biopsy or autopsy specimen, such as a tumor biopsy) or can include a cell (whether a primary cell or cultured cell) or medium conditioned by any cell, tissue or organ. Exemplary samples include, without limitation, cells, cell lysates, blood smears, cytocentrifuge preparations, cytology smears, bodily fluids (e.g., blood, plasma, serum, saliva, sputum, urine, bronchoalveolar lavage, semen, etc.), tissue biopsies (e.g., tumor biopsies), fine-needle aspirates, and/or tissue sections (e.g., cryostat tissue sections and/or paraffin-embedded tissue sections). In other examples, the sample includes circulating tumor cells (which can be identified by cell surface markers). In particular examples, samples are used directly (e.g., fresh or frozen), or can be manipulated prior to use, for example, by fixation (e.g., using formalin) and/or embedding in wax (such as formalin-fixed paraffin-embedded (FFPE) tissue samples). It will appreciated that any method of obtaining tissue from a subject can be utilized, and that the selection of the method used will depend upon various factors such as the type of tissue, age of the subject, or procedures available to the practitioner. Standard techniques for acquisition of such samples are available in the art. See, for example Schluger et al., *J. Exp. Med.* 176:1327-33 (1992); Bigby et al., *Am. Rev. Respir. Dis.* 133:515-18 (1986); Kovacs et al., *NEJM* 318:589-93 (1988); and Ognibene et al., *Am. Rev. Respir. Dis.* 129:929-32 (1984).

In other embodiments, a sample may be an environmental sample, such as water, soil, or a surface such as industrial or medical surface. In some embodiments, methods such as disclosed in US patent publication No. 2013/0190196 may be applied for detection of nucleic acid signatures, specifically RNA levels, directly from crude cellular samples with a high degree of sensitivity and specificity. Sequences specific to each pathogen of interest may be identified or selected by comparing the coding sequences from the pathogen of interest to all coding sequences in other organisms by BLAST software.

Several embodiments of the present disclosure involve the use of procedures and approaches known in the art to successfully fractionate clinical blood samples. See, e.g. the procedure described in Han Wei Hou et al., *Microfluidic Devices for Blood Fractionation*, Micromachines 2011, 2, 319-343; Ali Asgar S. Bhagat et al., *Dean Flow Fractionation (DEF) Isolation of Circulating Tumor Cells (CTCs) from Blood*, 15$^{th}$ International Conference on Miniaturized Systems for Chemistry and Life Sciences, Oct. 2-6, 2011, Seattle, WA; and International Patent Publication No. WO2011109762, the disclosures of which are herein incorporated by reference in their entirety. Blood samples are commonly expanded in culture to increase sample size for testing purposes. In some embodiments of the present invention, blood or other biological samples may be used in methods as described herein without the need for expansion in culture.

Further, several embodiments of the present disclosure involve the use of procedures and approaches known in the art to successfully isolate pathogens from whole blood using spiral microchannel, as described in Han Wei Hou et al., *Pathogen Isolation from Whole Blood Using Spiral Microchannel*, Case No. 15995JR, Massachusetts Institute of Technology, manuscript in preparation, the disclosure of which is herein incorporated by reference in its entirety.

Owing to the increased sensitivity of the embodiments disclosed herein, in certain example embodiments, the assays and methods may be run on crude samples or samples where the target molecules to be detected are not further fractionated or purified from the sample.

The invention is further described in the following examples, which do not limit the scope of the invention described in the claims.

EXAMPLES

Example 1. C2c2 Prevents Infection and Reduces Replication of Lymphocytic Choriomeningitis Virus (LCMV)

Figure 1B:
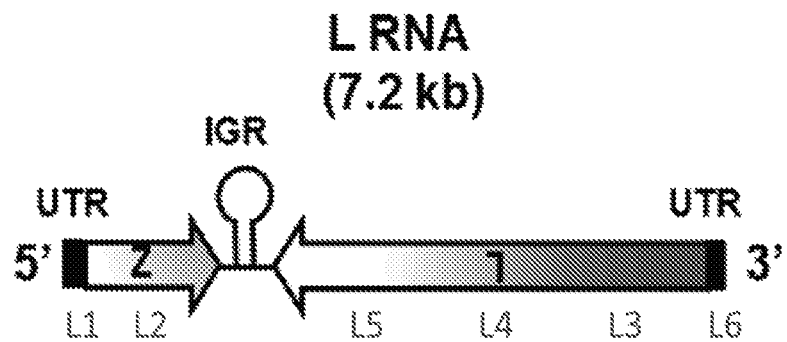

Guide RNAs were designed to bind to various areas of the LCMV genome, as indicated in FIGS. 1A and 1B, and are listed in Table 12 below.

TABLE 12

| gRNA annotation | gRNA sequence | SEQ ID NO |
|---|---|---|
| L1 | ctcacgaagaaagttgtgcaaccaaaca | 173 |
| L2 | tcttcaatctggttggtaatggatattt | 174 |
| L3 | gccaatttgttagtgtcctctataaatt | 175 |
| L4 | tatctcacagaccctatttgattttgcc | 176 |
| L5 | aaattettcattaaattcaccatttttg | 177 |
| L6 | tatagtttaaacataactctctcaattc | 178 |
| S1 | atccaaaaagcctaggatcccggtgcg | 179 |
| S2 | agaatgtcaagttgtattggatggttat | 180 |
| S3 | aaagcagccttgttgtagtcaattagtc | 181 |
| S4 | tgatctctttcttcttttgtcccttac | 182 |
| S5 | tctctttcttcttttgtcccttactat | 183 |
| S6 | caatcaaatgcctaggatccactgtgcg | 184 |

Figure 2B:
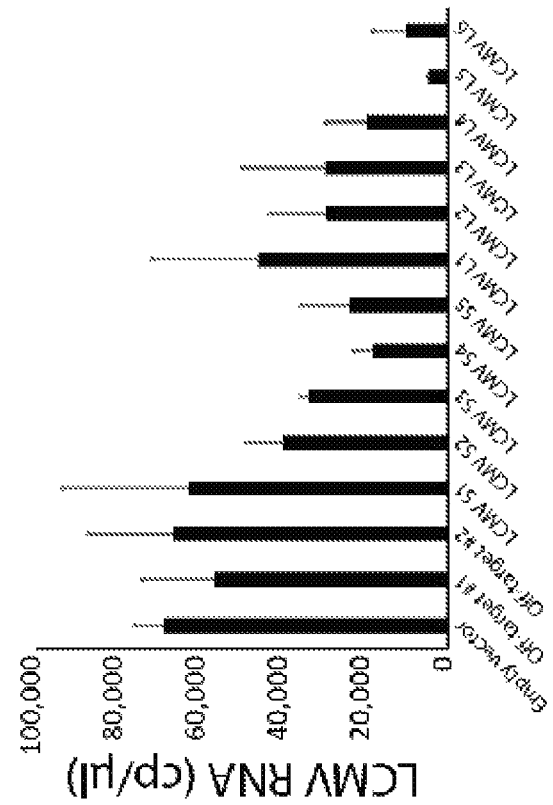
(FIG. 2B) Inhibition of viral replication. Empty vector, off-target #1 and off-target #2 are considered negative controls. S1-S5 and L1-L6 target various regions of the LCMV genome. Error bars indicate 1 standard deviation based on n=3-6 biological replicates.
Figure 2A:
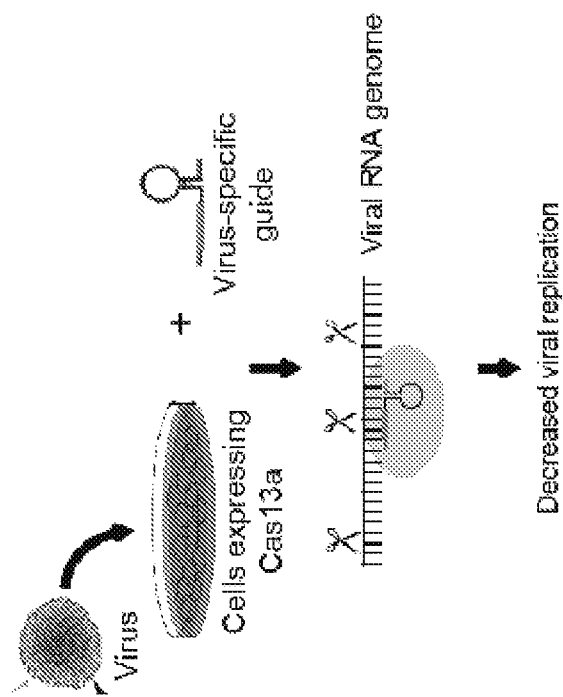
(FIG. 2A) HEK293FT cells were transfected with plasmids expressing Cas13a and single guide RNAs targeting LCMV or non-targeting controls. 24 hours post-transfection, cells were infected with LCMV at an MOI of 5, and viral titers were measured 48 hours post-infection using RT-qPCR of viral RNA in the culture supernatant.

A plasmid expressing *Leptotrichia wadei* (Lw) C2c2/Cas13a fused to msfGFP with a nuclear export signal, and a plasmid expressing guide RNA were transfected into 293 FT cells using Lipofectamine 2000. 293 FT cells were plated simultaneously to lipofectamine-plasmid mixture addition. After 24 h, the transfected 293 FT cells were infected with LCMV armstrong (MOI 5, 1h) (viral titer was determined by focus forming unit assay with Vero cells). After 1 hour of infection, cells were washed with citrate buffer to destroy virus remaining in the infection media that did not infect the cells. 48 hours post infection, virus-containing supernatant was removed and diluted 1:10 in Nuclease-free water and then used as input for RT-qPCR with primers against LCMV GP. The results are shown in FIG. 2B.

Figure 3:
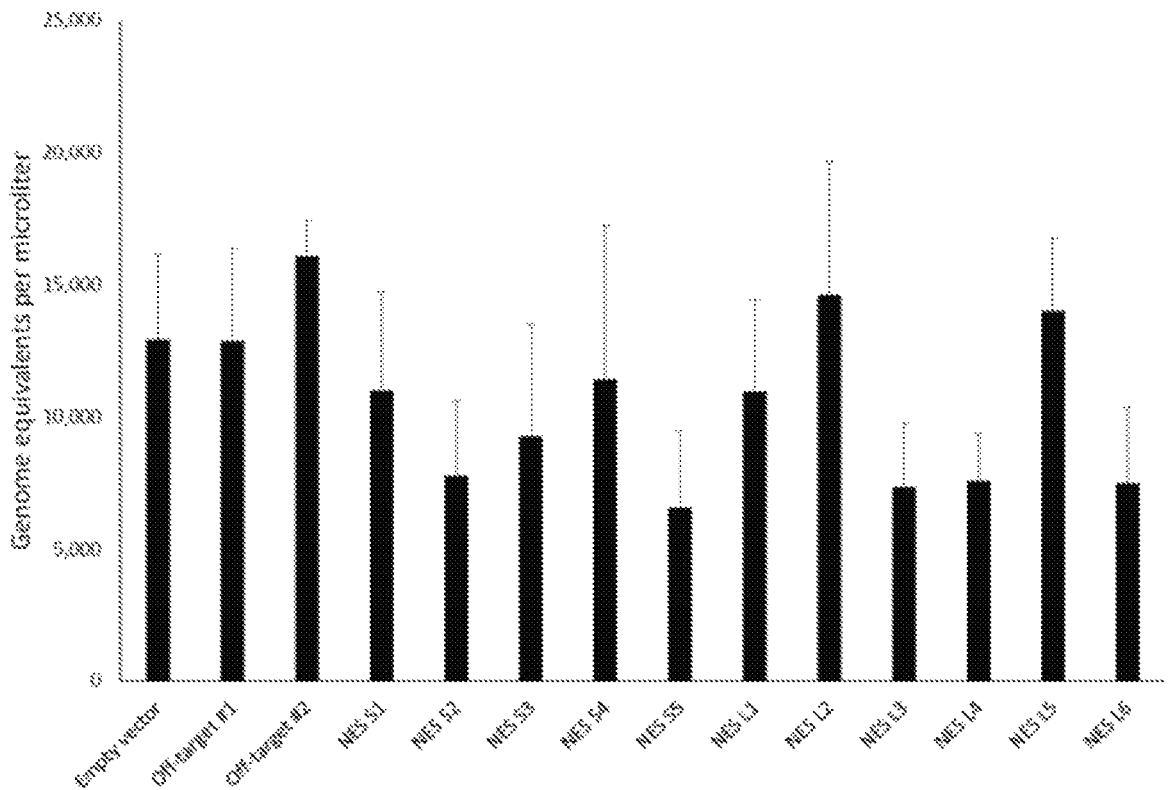
FIG. 3—Inhibition of viral replication. LCMV infected mammalian 293 FT cells were transfected with the indicated C2c2 and guide plasmids. Plots represent RT-qPCR values as genome equivalents per microliter with a bar for each transfected guide plasmid. Empty vector, off-target #1 and off-target #2 are considered negative controls. S1-S5 and L1-L6 target various regions of the LCMV genome. Error bars indicate 1 standard deviation based on n=6 biological replicates.

293 FT cells were plated 1 day prior to LCMV infection, so that infection was performed at approximately 80-85% confluency. 24h post plating, 293 FT cells were infected with LCMV Armstrong (MOI 5, 1h) (viral titer was determined by focus forming unit assay with Vero cells). After 1 hour of infection, cells were washed with citrate buffer to destroy virus remaining in the infection media that did not infect the cells. After 24h, a plasmid expressing Lw C2c2/Cas13a fused to msfGFP with a nuclear export signal, and a plasmid expressing guide RNA was transfected into 293 FT cells using Lipofectamine 2000. 48h after infection, virus-containing supernatant was removed and diluted 1:10 in Nuclease-free water and then used as input for RT-qPCR with primers against LCMV GP. The results are shown in FIG. 3.

Figure 4:
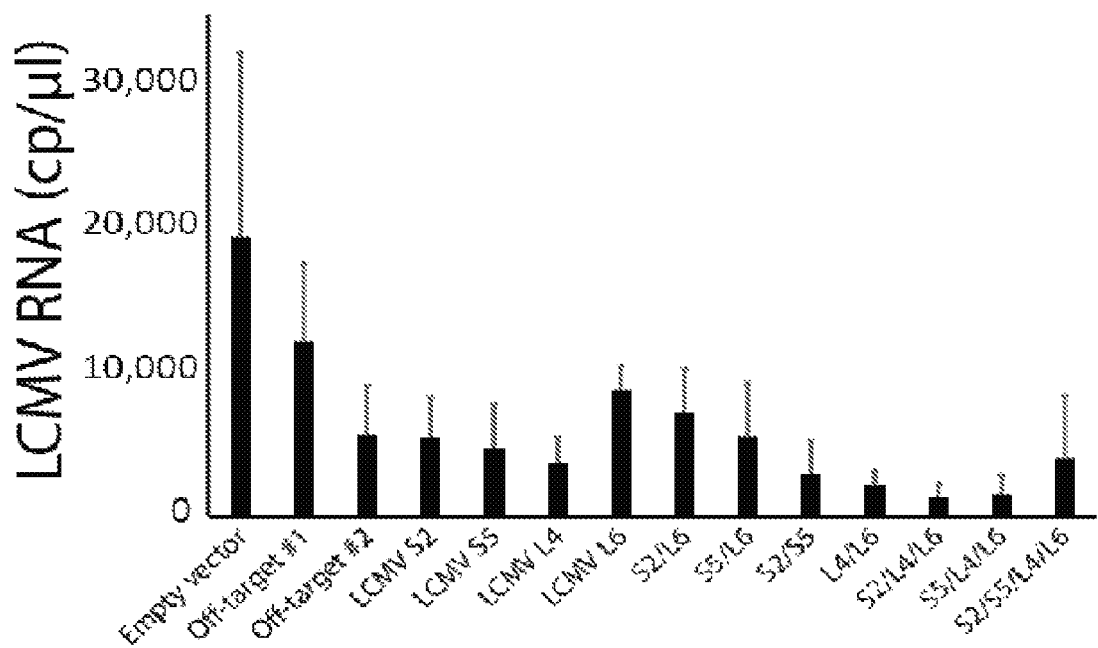
FIG. 4—Combinations of multiple guides enhance the Cas13a-mediated inhibition of LCMV replication. HEK293FT cells were transfected with plasmids expressing Cas13a and one or more guide RNAs targeting LCMV or non-targeting controls. LCMV infection was performed 24 hours post-transfection at an MOI of 5, and viral titers were measured 48 hours post infection usting RT-qPCR of viral RNA in the culture supernatant. Empty vector, off-target #1 and off-target #2 are considered negative controls. Error bars indicate one standard deviation based on n=6 biological replicates.

A plasmid expressing Lw C2c2/Cas13a fused to msfGFP with a nuclear export signal, and either a single plasmid or multiple plasmids expressing guide RNA(s) were transfected into 293 FT cells using Lipofectamine 2000. 293 FT cells were plated simultaneously to lipofectamine-plasmid mixture addition. Cells were transfected with 1 to 4 different guide RNAs. After 24 h, the cells were infected with LCMV Armstrong (MOI 5, 1h) (viral titer was determined by focus forming unit assay with Vero cells). After 1 hour of infection, cells were washed with citrate buffer to destroy virus remaining in the infection media that did not infect the cells. 48 hours post infection, virus-containing supernatant was removed and diluted 1:10 in Nuclease-free water and then used as input for RT-qPCR with primers against LCMV GP. The results are shown in FIG. 4.

From FIGS. 2B-4, it is clear that the CRISPR system designed to target viral RNA can reduce viral replication and thus viral load, which is even more pronounced when using multiple guide RNAs.

Example 2. Whole Genome Screen of LCMV for Cas13 Targeting Guides

A genome-wide screen was performed to identify the most efficient guide RNAs. 283 guide RNAs are tiled across the LCMV genome: every 50 nt on the coding strand (207 guides) and every 150 nt on the non-coding strand (76 guides).

LCMV Screen design and approach: To conduct a full-genome screen for guides that reduce LCMV replication guides were tiled across both the S and L segment of the LCMV genome. For coding regions, a 28 nt guide was designed every 50 nt along the coding region. For non-coding regions, guides were designed every 150 nt. There are 4 coding regions for LCMV for the four proteins (GPC, NP (or dN), Z and L) and each of these 4 proteins has their own non-coding region. With this strategy, 283 guides were tested total: GPC: 11 guides in the non-coding region and 32 guides in the coding region; NP: 12 guides in the non-coding region and 35 guides in the coding region; Z: 4 guides in the non-coding region and 7 guides in the coding region; L: 49 guides in the non-coding region and 133 guides in the coding region. The spacer sequences of the respective gRNAs, as well as their relative positions within the LCMV genome and LMCV genes are provided in Table 13 below.

TABLE 13

| | ID | Spacer sequence | | SEQ ID No. |
|---|---|---|---|---|
| 1 | L_targ_Z_Lsh/Lw2/Ca/LbFSL_1 | gttactcttcgtagggaggtggagagct | 1 | 185 |
| 2 | L_targ_Z_Lsh/Lw2/Ca/LbFSL_2 | ctggttggtaatggatatttacaaagag | 2 | 186 |
| 3 | L_targ_Z_Lsh/Lw2/Ca/LbFSL_3 | cagaaggtttaaacagtgcctgcaaagg | 3 | 187 |
| 4 | L_targ_Z_Lsh/Lw2/Ca/LbFSL_4 | agctgtcaaatttctgccagcaagattt | 4 | 188 |
| 5 | L_targ_Z_Lsh/Lw2/Ca/LbFSL_5 | gtggtatctggtaggatttcggccctgt | 5 | 189 |
| 6 | L_targ_Z_Lsh/Lw2/Ca/LbFSL_6 | ctctctggacttgccttgacccatcgct | 6 | 190 |
| 7 | L_targ_Z_Lsh/Lw2/Ca/LbFSL_7 | agcctcacgaagaaagttgtgcaaccaa | 7 | 191 |
| | | | | (START OF L) |
| 1 | L_targ_L_Lsh/Lw2/Ca/LbFSL_1 | tcagtcgatgtcctcggccaccgacccg | 8 | 192 |
| 2 | L_targ_L_Lsh/Lw2/Ca/LbFSL_2 | tcccottgagtctaaacctgcccccccac | 9 | 193 |
| 3 | L_targ_L_Lsh/Lw2/Ca/LbFSL_3 | ctagatttgctaaaacaaagtctgcaat | 10 | 194 |
| 4 | L_targ_L_Lsh/Lw2/Ca/LbFSL_4 | caaaagcgacagtggaatcagcagaata | 11 | 195 |
| 5 | L_targ_L_Lsh/Lw2/Ca/LbFSL_5 | ggaggattacacttatctctgaacccaa | 12 | 196 |
| 6 | L_targ_L_Lsh/Lw2/Ca/LbFSL_6 | cgatgcaggaagaggttcccaaggacat | 13 | 197 |
| 7 | L_targ_L_Lsh/Lw2/Ca/LbFSL_7 | aagtcctgctagaaagactttcatgtcc | 14 | 198 |
| 8 | L_targ_L_Lsh/Lw2/Ca/LbFSL_8 | tattttggacaaggtttcttccttcaaa | 15 | 199 |
| 9 | L_targ_L_Lsh/Lw2/Ca/LbFSL_9 | agtggcacaggctcccactcaggtccaa | 16 | 200 |
| 10 | L_targ_L_Lsh/Lw2/Ca/LbFSL_10 | aatcccatccagtattcttttggagccc | 17 | 201 |
| 11 | L_targ_L_Lsh/Lw2/Ca/LbFSL_11 | caccaagtatcaagggatcttccatgta | 18 | 202 |
| 12 | L_targ_L_Lsh/Lw2/Ca/LbFSL_12 | atatcaaagacaccatcgttcaccttga | 19 | 203 |
| 13 | L_targ_L_Lsh/Lw2/Ca/LbFSL_13 | gtggaggcattcatccaacattcttcta | 20 | 204 |
| 14 | L_targ_L_Lsh/Lw2/Ca/LbFSL_14 | gagagcatgataaaagttcagccacacc | 21 | 205 |
| 15 | L_targ_L_Lsh/Lw2/Ca/LbFSL_15 | accaagaatatcaatgaaaatttcctta | 22 | 206 |
| 16 | L_targ_L_Lsh/Lw2/Ca/LbFSL_16 | gtgcgtaaagtccactgaaattgaaaac | 23 | 207 |
| 17 | L_targ_L_Lsh/Lw2/Ca/LbFSL_17 | tgagcatgtagtcccacagatcctttaa | 24 | 208 |
| 18 | L_targ_L_Lsh/Lw2/Ca/LbFSL_18 | gtcaggccctgcctaatcaacatggcag | 25 | 209 |
| 19 | L_targ_L_Lsh/Lw2/Ca/LbFSL_19 | tcggtaagagaaccacccaaaaccaaac | 26 | 210 |
| 20 | L_targ_L_Lsh/Lw2/Ca/LbFSL_20 | gcctctccacattttgttcaccacctt | 27 | 211 |
| 21 | L_targ_L_Lsh/Lw2/Ca/LbFSL_21 | cccagtgcctcagcaccatcttcagatg | 28 | 212 |

TABLE 13-continued

| ID | | Spacer sequence | | SEQ ID No. |
|---|---|---|---|---|
| 22 | L_targ_L_Lsh/Lw2/Ca/LbFSL_22 | ccatgaaaaattgcctaatgtcctggtt | 29 | 213 |
| 23 | L_targ_L_Lsh/Lw2/Ca/LbFSL_23 | atgattcaaaatacacctgttttaagaa | 30 | 214 |
| 24 | L_targ_L_Lsh/Lw2/Ca/LbFSL_24 | ctaacaacaaattcatcaaccagactgg | 31 | 215 |
| 25 | L_targ_L_Lsh/Lw2/Ca/LbFSL_25 | ggcaaggtcagaaaacagaacagtgtaa | 32 | 216 |
| 26 | L_targ_L_Lsh/Lw2/Ca/LbFSL_26 | caacatgagaaatgagtgacaaggattc | 33 | 217 |
| 27 | L_targ_L_Lsh/Lw2/Ca/LbFSL_27 | cagaggtcaaggaatttaattctgggac | 34 | 218 |
| 28 | L_targ_L_Lsh/Lw2/Ca/LbFSL_28 | catgtcagacataaatggaagaagctga | 35 | 219 |
| 29 | L_targ_L_Lsh/Lw2/Ca/LbFSL_29 | accgcctcacagattgaatcacttggtt | 36 | 220 |
| 30 | L_targ_L_Lsh/Lw2/Ca/LbFSL_30 | agccttgagctctcaggctttcttgcta | 37 | 221 |
| 31 | L_targ_L_Lsh/Lw2/Ca/LbFSL_31 | cttaagagttaggttctcactgttattc | 38 | 222 |
| 32 | L_targ_L_Lsh/Lw2/Ca/LbFSL_32 | ggacccaaacacccaactcaaaagagtt | 39 | 223 |
| 33 | L_targ_L_Lsh/Lw2/Ca/LbFSL_33 | tcccaaagaagaggccttaaaaggcata | 40 | 224 |
| 34 | L_targ_L_Lsh/Lw2/Ca/LbFSL_34 | atgagactgtttgtcacaaatgtacagc | 41 | 225 |
| 35 | L_targ_L_Lsh/Lw2/Ca/LbFSL_35 | ctcttgtcacatgatcatctgtggttag | 42 | 226 |
| 36 | L_targ_L_Lsh/Lw2/Ca/LbFSL_36 | tacagattttccctattttigtttctca | 43 | 227 |
| 37 | L_targ_L_Lsh/Lw2/Ca/LbFSL_37 | gcaaaggcctataaagccagatgagata | 44 | 228 |
| 38 | L_targ_L_Lsh/Lw2/Ca/LbFSL_38 | tgattgcttctgacagcagcttctgtgc | 45 | 229 |
| 39 | L_targ_L_Lsh/Lw2/Ca/LbFSL_39 | agtttgttctggagtgtcttgatcaatg | 46 | 230 |
| 40 | L_targ_L_Lsh/Lw2/Ca/LbFSL_40 | agtcatcactgatggataaaccacctt | 47 | 231 |
| 41 | L_targ_L_Lsh/Lw2/Ca/LbFSL_41 | ggaacatttcattcaaattcaaccagtt | 48 | 232 |
| 42 | L_targ_L_Lsh/Lw2/Ca/LbFSL_42 | tcttcttcaagaccgaggaggtctccca | 49 | 233 |
| 43 | L_targ_L_Lsh/Lw2/Ca/LbFSL_43 | atctctgttaaataggtctaagaaaaat | 50 | 234 |
| 44 | L_targ_L_Lsh/Lw2/Ca/LbFSL_44 | tgagcttatgatgcagtttccttacaag | 51 | 235 |
| 45 | L_targ_L_Lsh/Lw2/Ca/LbFSL_45 | ttaggacacagttcctcaatgagtcttt | 52 | 236 |
| 46 | L_targ_L_Lsh/Lw2/Ca/LbFSL_46 | atccagccaatctttcacatcagtgttg | 53 | 237 |
| 47 | L_targ_L_Lsh/Lw2/Ca/LbFSL_47 | aagggaaattggcatactttaggaggtc | 54 | 238 |
| 48 | L_targ_L_Lsh/Lw2/Ca/LbFSL_48 | ttaactagggagactgggacgccatttg | 55 | 239 |
| 49 | L_targ_L_Lsh/Lw2/Ca/LbFSL_49 | atctattgtttcacaaagttgatgtggc | 56 | 240 |
| 50 | L_targ_L_Lsh/Lw2/Ca/LbFSL_50 | gcgctgcagatacaaactttgtgagaag | 57 | 241 |
| 51 | L_targ_L_Lsh/Lw2/Ca/LbFSL_51 | tagaatctagatttaaattctgcagcga | 58 | 242 |
| 52 | L_targ_L_Lsh/Lw2/Ca/LbFSL_52 | gctgataaatttgtttaacaagccgctc | 59 | 243 |
| 53 | L_targ_L_Lsh/Lw2/Ca/LbFSL_53 | ggacaaggacttcctccggatcacttac | 60 | 244 |
| 54 | L_targ_L_Lsh/Lw2/Ca/LbFSL_54 | tcaaataaagtgatctgatcatcacttg | 61 | 245 |
| 55 | L_targ_L_Lsh/Lw2/Ca/LbFSL_55 | gccaaagataacaccaatgcagtagttg | 62 | 246 |
| 56 | L_targ_L_Lsh/Lw2/Ca/LbFSL_56 | catagaagtcagaagcattatgcaagat | 63 | 247 |
| 57 | L_targ_L_Lsh/Lw2/Ca/LbFSL_57 | ctggatatatgggatggcactatcccca | 64 | 248 |
| 58 | L_targ_L_Lsh/Lw2/Ca/LbFSL_58 | tctctcagtaacagttgtttctgaaccc | 65 | 249 |
| 59 | L_targ_L_Lsh/Lw2/Ca/LbFSL_59 | tgacatatgatttcatcattgcattcac | 66 | 250 |
| 60 | L_targ_L_Lsh/Lw2/Ca/LbFSL_60 | agcttatgcatgtgccaagttaacaaag | 67 | 251 |

TABLE 13-continued

| | ID | Spacer sequence | | SEQ ID No. |
|---|---|---|---|---|
| 61 | L_targ_L_Lsh/Lw2/Ca/LbFSL_61 | acgcacatactggtcatcacctagtttg | 68 | 252 |
| 62 | L_targ_L_Lsh/Lw2/Ca/LbFSL_62 | acaaaaatgggcacatcattggtcccca | 69 | 253 |
| 63 | L_targ_L_Lsh/Lw2/Ca/LbFSL_63 | tttaagaacccttcccgcacattgatag | 70 | 254 |
| 64 | L_targ_L_Lsh/Lw2/Ca/LbFSL_64 | aaattccttatcattgtttaaacaggag | 71 | 255 |
| 65 | L_targ_L_Lsh/Lw2/Ca/LbFSL_65 | actcaaaataatcttctattaaccttgt | 72 | 256 |
| 66 | L_targ_L_Lsh/Lw2/Ca/LbFSL_66 | ccaatatagagttctctatttcccccaa | 73 | 257 |
| 67 | L_targ_L_Lsh/Lw2/Ca/LbFSL_67 | aaatttcagccttccagagtcaggacct | 74 | 258 |
| 68 | L_targ_L_Lsh/Lw2/Ca/LbFSL_68 | attcttctgagtagaagcacagattttt | 75 | 259 |
| 69 | L_targ_L_Lsh/Lw2/Ca/LbFSL_69 | gtcaacgacagagctttactaagggact | 76 | 260 |
| 70 | L_targ_L_Lsh/Lw2/Ca/LbFSL_70 | gattctcacgtcttcttccagtttgtcc | 77 | 261 |
| 71 | L_targ_L_Lsh/Lw2/Ca/LbFSL_71 | cttgcctttgcatatgcctgtatttccc | 78 | 262 |
| 72 | L_targ_L_Lsh/Lw2/Ca/LbFSL_72 | tgcaacagaatcatcttcatgcaagaaa | 79 | 263 |
| 73 | L_targ_L_Lsh/Lw2/Ca/LbFSL_73 | cttttctacaaaggttttttgccatctca | 80 | 264 |
| 74 | L_targ_L_Lsh/Lw2/Ca/LbFSL_74 | tgactgaggtgaaatacaaaggtgacag | 81 | 265 |
| 75 | L_targ_L_Lsh/Lw2/Ca/LbFSL_75 | tcacagataaatttcatgtcatcattgg | 82 | 266 |
| 76 | L_targ_L_Lsh/Lw2/Ca/LbFSL_76 | ttctactaaatggaaagatatttctgac | 83 | 267 |
| 77 | L_targ_L_Lsh/Lw2/Ca/LbFSL_77 | ccatcttccctgttagaataagctgtaa | 84 | 268 |
| 78 | L_targ_L_Lsh/Lw2/Ca/LbFSL_78 | gtaagttttctccatctcctttgtcat | 85 | 269 |
| 79 | L_targ_L_Lsh/Lw2/Ca/LbFSL_79 | ccgtgctattgtggtgttgacctttct | 86 | 270 |
| 80 | L_targ_L_Lsh/Lw2/Ca/LbFSL_80 | tctcttcttctccatcaaaacatatttc | 87 | 271 |
| 81 | L_targ_L_Lsh/Lw2/Ca/LbFSL_81 | cctgtctcttctcccttggaaccgatga | 88 | 272 |
| 82 | L_targ_L_Lsh/Lw2/Ca/LbFSL_82 | aactttatattcatagtctgagtggctc | 89 | 273 |
| 83 | L_targ_L_Lsh/Lw2/Ca/LbFSL_83 | cgaaactctccgtaatttgactcacagc | 90 | 274 |
| 84 | L_targ_L_Lsh/Lw2/Ca/LbFSL_84 | tcatattccagaagtcgttctccattta | 91 | 275 |
| 85 | L_targ_L_Lsh/Lw2/Ca/LbFSL_85 | tttgttactagcaagatctaatgctgtc | 92 | 276 |
| 86 | L_targ_L_Lsh/Lw2/Ca/LbFSL_86 | gatctaggctgtttagcttcttctctcc | 93 | 277 |
| 87 | L_targ_L_Lsh/Lw2/Ca/LbFSL_87 | ttaaatgaagacaccattaggctaaagg | 94 | 278 |
| 88 | L_targ_L_Lsh/Lw2/Ca/LbFSL_88 | tgtatgctgacagtcaatttctttacta | 95 | 279 |
| 89 | L_targ_L_Lsh/Lw2/Ca/LbFSL_89 | agaacacacattcttcctcaggagtgat | 96 | 280 |
| 90 | L_targ_L_Lsh/Lw2/Ca/LbFSL_90 | aaaccaaattgacttttgggctcaaaga | 97 | 281 |
| 91 | L_targ_L_Lsh/Lw2/Ca/LbFSL_91 | atctgttagcctgtcaggggtctcctttt | 98 | 282 |
| 92 | L_targ_L_Lsh/Lw2/Ca/LbFSL_92 | acacattcaacataaatttaaattttgc | 99 | 283 |
| 93 | L_targ_L_Lsh/Lw2/Ca/LbFSL_93 | gtaccaaaaatagttttttattaggaatc | 100 | 284 |
| 94 | L_targ_L_Lsh/Lw2/Ca/LbFSL_94 | ctcagcaggtgtgatcagatcctccctc | 101 | 285 |
| 95 | L_targ_L_Lsh/Lw2/Ca/LbFSL_95 | atgagaaatctgacactattgccatcac | 102 | 286 |
| 96 | L_targ_L_Lsh/Lw2/Ca/LbFSL_96 | tgcttttgatttctctttgttgggttgg | 103 | 287 |
| 97 | L_targ_L_Lsh/Lw2/Ca/LbFSL_97 | cctcagtgcaacctcaatgtcggtgaga | 104 | 288 |
| 98 | L_targ_L_Lsh/Lw2/Ca/LbFSL_98 | atctaatccatgaaatcatgatgtctat | 105 | 289 |
| 99 | L_targ_L_Lsh/Lw2/Ca/LbFSL_99 | gaaaaaattggtaaaaagaacctttag | 106 | 290 |

TABLE 13-continued

| | ID | Spacer sequence | | SEQ ID No. |
|---|---|---|---|---|
| 100 | L_targ_L_Lsh/Lw2/Ca/LbFSL_100 | atgaccatccgggccttgtatggagtag | 107 | 291 |
| 101 | L_targ_L_Lsh/Lw2/Ca/LbFSL_101 | tctggtataataggtggtattcttcaga | 108 | 292 |
| 102 | L_targ_L_Lsh/Lw2/Ca/LbFSL_102 | aacacttctttgcattctaccacttgat | 109 | 293 |
| 103 | L_targ_L_Lsh/Lw2/Ca/LbFSL_103 | ttgccttagtctagcaactgagctagtt | 110 | 294 |
| 104 | L_targ_L_Lsh/Lw2/Ca/LbFSL_104 | gacaaacagatgataatcttctcaggct | 111 | 295 |
| 105 | L_targ_L_Lsh/Lw2/Ca/LbFSL_105 | gtgctgggttggaaattgtaatcttcaa | 112 | 296 |
| 106 | L_targ_L_Lsh/Lw2/Ca/LbFSL_106 | gtgagctccaattttcataaagttctca | 113 | 297 |
| 107 | L_targ_L_Lsh/Lw2/Ca/LbFSL_107 | attcttgctcaaggtgttcagacagtcc | 114 | 298 |
| 108 | L_targ_L_Lsh/Lw2/Ca/LbFSL_108 | accactaacaggcatttttgaatttttg | 115 | 299 |
| 109 | L_targ_L_Lsh/Lw2/Ca/LbFSL_109 | cctaaacaattcctcaaaagacaccttt | 116 | 300 |
| 110 | L_targ_L_Lsh/Lw2/Ca/LbFSL_110 | tattcctcaaaagtctaatgaactcctc | 117 | 301 |
| 111 | L_targ_L_Lsh/Lw2/Ca/LbFSL_111 | agcctatcattcacactactatagcaac | 118 | 302 |
| 112 | L_targ_L_Lsh/Lw2/Ca/LbFSL_112 | ttttaaccctttgaatttcgactgtttt | 119 | 303 |
| 113 | L_targ_L_Lsh/Lw2/Ca/LbFSL_113 | catccagatttaacaactgtctccttct | 120 | 304 |
| 114 | L_targ_L_Lsh/Lw2/Ca/LbFSL_114 | ttgactttgtttaacatagagaggagcc | 121 | 305 |
| 115 | L_targ_L_Lsh/Lw2/Ca/LbFSL_115 | acttcccctttcgtgcccatgggtctct | 122 | 306 |
| 116 | L_targ_L_Lsh/Lw2/Ca/LbFSL_116 | gacaggattccactgcctccctgcttaa | 123 | 307 |
| 117 | L_targ_L_Lsh/Lw2/Ca/LbFSL_117 | gcaaggttttcatagagctcagagaatt | 124 | 308 |
| 118 | L_targ_L_Lsh/Lw2/Ca/LbFSL_118 | tactttctgaaagtttctctttaatttc | 125 | 309 |
| 119 | L_targ_L_Lsh/Lw2/Ca/LbFSL_119 | acctgctgaaaagagagtttattccaaa | 126 | 310 |
| 120 | L_targ_L_Lsh/Lw2/Ca/LbFSL_120 | ttggggttgatgccttcgtggcacatcc | 127 | 311 |
| 121 | L_targ_L_Lsh/Lw2/Ca/LbFSL_121 | tgacctcgcatctttcagaattttcata | 128 | 312 |
| 122 | L_targ_L_Lsh/Lw2/Ca/LbFSL_122 | cgatagtagtcttcagggactcacagag | 129 | 313 |
| 123 | L_targ_L_Lsh/Lw2/Ca/LbFSL_123 | aagactttctcattttggttagaatact | 130 | 314 |
| 124 | L_targ_L_Lsh/Lw2/Ca/LbFSL_124 | tctaaatttgaagtttgcccactctggc | 131 | 315 |
| 125 | L_targ_L_Lsh/Lw2/Ca/LbFSL_125 | aacgaccatctactattggaactaatgt | 132 | 316 |
| 126 | L_targ_L_Lsh/Lw2/Ca/LbFSL_126 | tccctgatgcatgccaatttgttagtgt | 133 | 317 |
| 127 | L_targ_L_Lsh/Lw2/Ca/LbFSL_127 | actggctggagtgctcctaacaaaacac | 134 | 318 |
| 128 | L_targ_L_Lsh/Lw2/Ca/LbFSL_128 | ctatcagcttgtaaccatcaggaatgat | 135 | 319 |
| 129 | L_targ_L_Lsh/Lw2/Ca/LbFSL_129 | attccagactccaccaaaattgtttcca | 136 | 320 |
| 130 | L_targ_L_Lsh/Lw2/Ca/LbFSL_130 | tgtgcagccactcttgtctgcactgtct | 137 | 321 |
| 131 | L_targ_L_Lsh/Lw2/Ca/LbFSL_131 | acttgagtccctcaatcagaaccattct | 138 | 322 |
| 132 | L_targ_L_Lsh/Lw2/Ca/LbFSL_132 | ttgagtttctgccttgacaacctctcat | 139 | 323 |
| | | | | START OF GPC |
| 133 | L_targ_L_Lsh/Lw2/Ca/LbFSL_133 | taactctctcaattctgagatgatttca | 140 | 324 |
| 1 | S_targ_GPC_Lsh/Lw2/Ca/LbFSL_1 | ttcagcgtcttttccagacggtttttac | 141 | 325 |
| 2 | S_targ_GPC_Lsh/Lw2/Ca/LbFSL_2 | caactacaaattcctttgttggttaatc | 142 | 326 |
| 3 | S_targ_GPC_Lsh/Lw2/Ca/LbFSL_3 | accttttatgtgcctgtgtgttggtatt | 143 | 327 |

TABLE 13-continued

| | ID | Spacer sequence | | SEQ ID No. |
|---|---|---|---|---|
| 4 | S_targ_GPC_Lsh/Lw2/Ca/LbFSL_4 | tgactagatatgcagatgtggaaaacat | 144 | 328 |
| 5 | S_targ_GPC_Lsh/Lw2/Ca/LbFSL_5 | ggggtactcccctgcctctttatgtaat | 145 | 329 |
| 6 | S_targ_GPC_Lsh/Lw2/Ca/LbFSL_6 | catgttatcggcttcctgttcgatttga | 146 | 330 |
| 7 | S_targ_GPC_Lsh/Lw2/Ca/LbFSL_7 | agtaagaaccattggtgacaagccagca | 147 | 331 |
| 8 | S_targ_GPC_Lsh/Lw2/Ca/LbFSL_8 | gtctttgcatgttctaggtaccaaaact | 148 | 332 |
| 9 | S_targ_GPC_Lsh/Lw2/Ca/LbFSL_9 | ccccatcagatctctcaagtggttcctc | 149 | 333 |
| 10 | S_targ_GPC_Lsh/Lw2/Ca/LbFSL_10 | aagaattcactgttgttttgaataagtg | 150 | 334 |
| 11 | S_targ_GPC_Lsh/Lw2/Ca/LbFSL_11 | ttgaacttactcaaagcagccttgttgt | 151 | 335 |
| 12 | S_targ_GPC_Lsh/Lw2/Ca/LbFSL_12 | acagaattcttcatcatgatttacattg | 152 | 336 |
| 13 | S_targ_GPC_Lsh/Lw2/Ca/LbFSL_13 | cgaaacacttaagctctgcagcaagaat | 153 | 337 |
| 14 | S_targ_GPC_Lsh/Lw2/Ca/LbFSL_14 | ccacctggattctccacccctgaagagt | 154 | 338 |
| 15 | S_targ_GPC_Lsh/Lw2/Ca/LbFSL_15 | gcccgctagtctcctagtgaagaactta | 155 | 339 |
| 16 | S_targ_GPC_Lsh/Lw2/Ca/LbFSL_16 | tcctggacatcccaaaaggacctgcata | 156 | 340 |
| 17 | S_targ_GPC_Lsh/Lw2/Ca/LbFSL_17 | ctatitigtataatcaggtattggtaac | 157 | 341 |
| 18 | S_targ_GPC_Lsh/Lw2/Ca/LbFSL_18 | cttgccatctgagcctgtccagccccag | 158 | 342 |
| 19 | S_targ_GPC_Lsh/Lw2/Ca/LbFSL_19 | cgaaggcagttctaaacatatctaggac | 159 | 343 |
| 20 | S_targ_GPC_Lsh/Lw2/Ca/LbFSL_20 | tggctctgagcactttgtgcatttgaga | 160 | 344 |
| 21 | S_targ_GPC_Lsh/Lw2/Ca/LbFSL_21 | tatgccattgttgaagtcgcaggatact | 161 | 345 |
| 22 | S_targ_GPC_Lsh/Lw2/Ca/LbFSL_22 | tgatactgaggtgtaggctcgaaactat | 162 | 346 |
| 23 | S_targ_GPC_Lsh/Lw2/Ca/LbFSL_23 | gtctttttattgaaggcagaggtcagat | 163 | 347 |
| 24 | S_targ_GPC_Lsh/Lw2/Ca/LbFSL_24 | ggaatcattggtgaaggtcaattctagt | 164 | 348 |
| 25 | S_targ_GPC_Lsh/Lw2/Ca/LbFSL_25 | aatggtgggagttgttggctgaacatgc | 165 | 349 |
| 26 | S_targ_GPC_Lsh/Lw2/Ca/LbFSL_26 | tgtgacatatcaaactccactgacttaa | 166 | 350 |
| 27 | S_targ_GPC_Lsh/Lw2/Ca/LbFSL_27 | gtcgggtcccttaagaccgtacatgcca | 167 | 351 |
| 28 | S_targ_GPC_Lsh/Lw2/Ca/LbFSL_28 | ggaaactgatcaatgcgaatatcccaca | 168 | 352 |
| 29 | S_targ_GPC_Lsh/Lw2/Ca/LbFSL_29 | ttgatacccgtgatcacgataagcacaa | 169 | 353 |
| 30 | S_targ_GPC_Lsh/Lw2/Ca/LbFSL_30 | atcgatgatgtgaggcagagcctcaaac | 170 | 354 |
| 31 | S_targ_GPC_Lsh/Lw2/Ca/LbFSL_31 | ttctgtaggatagggcctgacacccagt | 171 | 355 |
| | | | | START OF NP |
| 32 | S_targ_GPC_Lsh/Lw2/Ca/LbFSL_32 | caaaaagcctaggatccccggtgcg | 172 | 356 |
| 1 | S_targ_NP_Lsh/Lw2/Ca/LbFSL_1 | cttagagtgtcacaacatttgggcctct | 173 | 357 |
| 2 | S_targ_NP_Lsh/Lw2/Ca/LbFSL_2 | atgttgtgaacagttttcagatctggga | 174 | 358 |
| 3 | S_targ_NP_Lsh/Lw2/Ca/LbFSL_3 | aaaaatgatgcagtccatgagtgcacag | 175 | 359 |
| 4 | S_targ_NP_Lsh/Lw2/Ca/LbFSL_4 | ttttgtcccttactattccagtatgcat | 176 | 360 |
| 5 | S_targ_NP_Lsh/Lw2/Ca/LbFSL_5 | tcccacactttgtcttcatactccctcg | 177 | 361 |
| 6 | S_targ_NP_Lsh/Lw2/Ca/LbFSL_6 | atcgataagcttaatgtccttcctattc | 178 | 362 |
| 7 | S_targ_NP_Lsh/Lw2/Ca/LbFSL_7 | tgtcatcggagccttgacagcttagaac | 179 | 363 |
| 8 | S_targ_NP_Lsh/Lw2/Ca/LbFSL_8 | ataactgacgaggtcaacccgggttgcg | 180 | 364 |
| 9 | S_targ_NP_Lsh/Lw2/Ca/LbFSL_9 | catgccgtgtgagtacttggaatcttgc | 181 | 365 |

TABLE 13-continued

| | ID | Spacer sequence | | SEQ ID No. |
|---|---|---|---|---|
| 10 | S_targ_NP_Lsh/Lw2/Ca/LbFSL_10 | gttccctgtaaaagtgtatgaactgccc | 182 | 366 |
| 11 | S_targ_NP_Lsh/Lw2/Ca/LbFSL_11 | atttccactggatcattaaatctaccct | 183 | 367 |
| 12 | S_targ_NP_Lsh/Lw2/Ca/LbFSL_12 | gttggggtcaattcctcccatgaggtct | 184 | 368 |
| 13 | S_targ_NP_Lsh/Lw2/Ca/LbFSL_13 | agcttaagcccacctgaggtggacctgc | 185 | 369 |
| 14 | S_targ_NP_Lsh/Lw2/Ca/LbFSL_14 | gagttgactgcaggtttctcgcttgtga | 186 | 370 |
| 15 | S_targ_NP_Lsh/Lw2/Ca/LbFSL_15 | tgctctccccacaatcgatgttctacaa | 187 | 371 |
| 16 | S_targ_NP_Lsh/Lw2/Ca/LbFSL_16 | ctgaaaggcaaactttatagaggatgtt | 188 | 372 |
| 17 | S_targ_NP_Lsh/Lw2/Ca/LbFSL_17 | acttggtctgaaacaaacatgttgagtt | 189 | 373 |
| 18 | S_targ_NP_Lsh/Lw2/Ca/LbFSL_18 | cttcaagaggtcctcgctgttgcttggc | 190 | 374 |
| 19 | S_targ_NP_Lsh/Lw2/Ca/LbFSL_19 | tgttaccccatccaacagggctgcccc | 191 | 375 |
| 20 | S_targ_NP_Lsh/Lw2/Ca/LbFSL_20 | ctaaagttatagccagaaatgttgatgc | 192 | 376 |
| 21 | S_targ_NP_Lsh/Lw2/Ca/LbFSL_21 | ccccagaactgggtgcttgtctttcagc | 193 | 377 |
| 22 | S_targ_NP_Lsh/Lw2/Ca/LbFSL_22 | gatacttgactgtgtaaagcaagccaag | 194 | 378 |
| 23 | S_targ_NP_Lsh/Lw2/Ca/LbFSL_23 | tcattgagcggagtctgtgactgtttgg | 195 | 379 |
| 24 | S_targ_NP_Lsh/Lw2/Ca/LbFSL_24 | tggcattgtgccaaattgattgttcaaa | 196 | 380 |
| 25 | S_targ_NP_Lsh/Lw2/Ca/LbFSL_25 | aaactcttaccacaccacttgcaccctg | 197 | 381 |
| 26 | S_targ_NP_Lsh/Lw2/Ca/LbFSL_26 | atctgtaggatctgagatctttggtcta | 198 | 382 |
| 27 | S_targ_NP_Lsh/Lw2/Ca/LbFSL_27 | catatataccctgaagcctggggcctt | 199 | 383 |
| 28 | S_targ_NP_Lsh/Lw2/Ca/LbFSL_28 | tcagcttctcaaggtcagccgcaagaga | 200 | 384 |
| 29 | S_targ_NP_Lsh/Lw2/Ca/LbFSL_29 | ctccccactttcaaaacattcttctttg | 201 | 385 |
| 30 | S_targ_NP_Lsh/Lw2/Ca/LbFSL_30 | agaatgtacagtctggttgagacttctg | 202 | 386 |
| 31 | S_targ_NP_Lsh/Lw2/Ca/LbFSL_31 | ctctcttttccttcctcatgatcctctg | 203 | 387 |
| 32 | S_targ_NP_Lsh/Lw2/Ca/LbFSL_32 | tccaacccattcagaaggttggttgcat | 204 | 388 |
| 33 | S_targ_NP_Lsh/Lw2/Ca/LbFSL_33 | atctgatgtgaagctctgcaattctctt | 205 | 389 |
| 34 | S_targ_NP_Lsh/Lw2/Ca/LbFSL_34 | agctcttaacttccttagacaaggacat | 206 | 390 |
| 35 | S_targ_NP_Lsh/Lw2/Ca/LbFSL_35 | agacaaatgcgcaatcaaatgcctagga | 207 | 391 |
| | | | | START OF Znc |
| 1 | L_targ_Znc_Lsh/Lw2/Ca/LbFSL_1 | cgcaccgaggatcctaggcttttgatg | 208 | 392 |
| 2 | L_targ_Znc_Lsh/Lw2/Ca/LbFSL_2 | ttgagggactcaagttgctgtcacgctg | 209 | 393 |
| 3 | L_targ_Znc_Lsh/Lw2/Ca/LbFSL_3 | gttacaagctgatagacaattctctcat | 210 | 394 |
| 4 | L_targ_Znc_Lsh/Lw2/Ca/LbFSL_4 | tagtagatggtcgttgtgattatgataa | 211 | 395 |
| | | | | START of Lnc |
| 1 | L_targ_Lnc_Lsh/Lw2/Ca/LbFSL_1 | cgcaccgaggatcctaggcttttgatg | 212 | 396 |
| 2 | L_targ_Lnc_Lsh/Lw2/Ca/LbFSL_2 | ttgagggactcaagttgctgtcacgctg | 213 | 397 |
| 3 | L_targ_Lnc_Lsh/Lw2/Ca/LbFSL_3 | gttacaagctgatagacaattctctcat | 214 | 398 |
| 4 | L_targ_Lnc_Lsh/Lw2/Ca/LbFSL_4 | tagtagatggtcgttgtgattatgataa | 215 | 399 |
| 5 | L_targ_Lnc_Lsh/Lw2/Ca/LbFSL_5 | tgaagactactatcgacaagcgctccgg | 216 | 400 |
| 6 | L_targ_Lnc_Lsh/Lw2/Ca/LbFSL_6 | ctcttttcagcaggtttagaagagattt | 217 | 401 |
| 7 | L_targ_Lnc_Lsh/Lw2/Ca/LbFSL_7 | cagtggaatcctgtcctttgatgagatt | 218 | 402 |

TABLE 13-continued

| | ID | Spacer sequence | | SEQ ID No. |
|---|---|---|---|---|
| 8 | L_targ_Lnc_Lsh/Lw2/Ca/LbFSL_8 | tgttaaatctggatgttttgtgtctttc | 219 | 403 |
| 9 | L_targ_Lnc_Lsh/Lw2/Ca/LbFSL_9 | gacttttgaggaatagaaaaaagtcaaa | 220 | 404 |
| 10 | L_targ_Lnc_Lsh/Lw2/Ca/LbFSL_10 | accttgagcaagaatgccacataccatt | 221 | 405 |
| 11 | L_targ_Lnc_Lsh/Lw2/Ca/LbFSL_11 | tatcatctgtttgtctggccttaacaaa | 222 | 406 |
| 12 | L_targ_Lnc_Lsh/Lw2/Ca/LbFSL_12 | acctattataccagaagactggagaatc | 223 | 407 |
| 13 | L_targ_Lnc_Lsh/Lw2/Ca/LbFSL_13 | tttcatggattagatcatgtcctgattt | 224 | 408 |
| 14 | L_targ_Lnc_Lsh/Lw2/Ca/LbFSL_14 | tgtcagatttctcatctacatcattaat | 225 | 409 |
| 15 | L_targ_Lnc_Lsh/Lw2/Ca/LbFSL_15 | ttatgttgaatgtgtcatacctgtgtca | 226 | 410 |
| 16 | L_targ_Lnc_Lsh/Lw2/Ca/LbFSL_16 | aagaatgtgtgttctatgagcaaatgaa | 227 | 411 |
| 17 | L_targ_Lnc_Lsh/Lw2/Ca/LbFSL_17 | taaacagcctagatcccatgactaactc | 228 | 412 |
| 18 | L_targ_Lnc_Lsh/Lw2/Ca/LbFSL_18 | ttacggagagtttcgtaagaaaacaaaa | 229 | 413 |
| 19 | L_targ_Lnc_Lsh/Lw2/Ca/LbFSL_19 | atggagaagaagagacaagcttcttcaa | 230 | 414 |
| 20 | L_targ_Lnc_Lsh/Lw2/Ca/LbFSL_20 | taacagggaagatggctcacttaagaaa | 231 | 415 |
| 21 | L_targ_Lnc_Lsh/Lw2/Ca/LbFSL_21 | atttcacctcagtcattaaagatcagtg | 232 | 416 |
| 22 | L_targ_Lnc_Lsh/Lw2/Ca/LbFSL_22 | atatgcaaaggcaaggcttgaatttcaa | 233 | 417 |
| 23 | L_targ_Lnc_Lsh/Lw2/Ca/LbFSL_23 | tctactcagaagaatcaccaacatcata | 234 | 418 |
| 24 | L_targ_Lnc_Lsh/Lw2/Ca/LbFSL_24 | aagattattttgagtcttttttcaagttt | 235 | 419 |
| 25 | L_targ_Lnc_Lsh/Lw2/Ca/LbFSL_25 | tgtgcccattttttgttcttaatgtttct | 236 | 420 |
| 26 | L_targ_Lnc_Lsh/Lw2/Ca/LbFSL_26 | tgaaatcatatgtcaagtcgaagctaaa | 237 | 421 |
| 27 | L_targ_Lnc_Lsh/Lw2/Ca/LbFSL_27 | cttctgacttctatggtttgcttagcga | 238 | 422 |
| 28 | L_targ_Lnc_Lsh/Lw2/Ca/LbFSL_28 | aggaagtccttgtcctgttggaattcca | 239 | 423 |
| 29 | L_targ_Lnc_Lsh/Lw2/Ca/LbFSL_29 | ttgtatctgcagcgctacacaatgtcaa | 240 | 424 |
| 30 | L_targ_Lnc_Lsh/Lw2/Ca/LbFSL_30 | atgccaatttcccttttggatccatttct | 241 | 425 |
| 31 | L_targ_Lnc_Lsh/Lw2/Ca/LbFSL_31 | tgcatcataagctcaaaaatggtgaatt | 242 | 426 |
| 32 | L_targ_Lnc_Lsh/Lw2/Ca/LbFSL_32 | tgaatgaaatgttcccattaaggatggt | 243 | 427 |
| 33 | L_targ_Lnc_Lsh/Lw2/Ca/LbFSL_33 | tgtcagaagcaatcaacaagtcagcttt | 244 | 428 |
| 34 | L_targ_Lnc_Lsh/Lw2/Ca/LbFSL_34 | atcatgtgacaagagtttgcaatcggga | 245 | 429 |
| 35 | L_targ_Lnc_Lsh/Lw2/Ca/LbFSL_35 | tgggtgtttgggtcctagcagaaccgac | 246 | 430 |
| 36 | L_targ_Lnc_Lsh/Lw2/Ca/LbFSL_36 | aatctgtgaggcggttatatcccaagat | 247 | 431 |
| 37 | L_targ_Lnc_Lsh/Lw2/Ca/LbFSL_37 | tcatttctcatgttgttaagtggaaaag | 248 | 432 |
| 38 | L_targ_Lnc_Lsh/Lw2/Ca/LbFSL_38 | tgtattttgaatcatttgttcgagaatt | 249 | 433 |
| 39 | L_targ_Lnc_Lsh/Lw2/Ca/LbFSL_39 | aaaatgtggagaggcctatgtttaggaa | 250 | 434 |
| 40 | L_targ_Lnc_Lsh/Lw2/Ca/LbFSL_40 | gggactacatgctcaactacacaaaagg | 251 | 435 |
| 41 | L_targ_Lnc_Lsh/Lw2/Ca/LbFSL_41 | ttttatcatgctctcacctcttttaaggg | 252 | 436 |
| 42 | L_targ_Lnc_Lsh/Lw2/Ca/LbFSL_42 | ccttgatacttggtgattctcttgagct | 253 | 437 |
| 43 | L_targ_Lnc_Lsh/Lw2/Ca/LbFSL_43 | accttgtccaaaatatcattgtgaagct | 254 | 438 |
| 44 | L_targ_Lnc_Lsh/Lw2/Ca/LbFSL_44 | taagtgtaatcctccaggaactatgtat | 255 | 439 |
| 45 | L_targ_Lnc_Lsh/Lw2/Ca/LbFSL_45 | ttagactcaaggggaggtcctgcgacga | 256 | 440 |
| 46 | L_targ_Lnc_Lsh/Lw2/Ca/LbFSL_46 | gtgggtgtgtgtgtgtgtgtgtgtgcgt | 257 | 441 |

TABLE 13-continued

| | ID | Spacer sequence | | SEQ ID No. |
|---|---|---|---|---|
| 47 | L_targ_Lnc_Lsh/Lw2/Ca/LbFSL_47 | tgttgatatcttcaatctggttggtaat | 258 | 442 |
| 48 | L_targ_Lnc_Lsh/Lw2/Ca/LbFSL_48 | taaagggccaagataggtggtatctggt | 259 | 443 |
| 49 | L_targ_Lnc_Lsh/Lw2/Ca/LbFSL_49 | caactaaacgcctaggatccccggtgcg | 260 | 444 |
| | | START OF GPCnc | | |
| 1 | S_targ_GPCnc_Lsh/Lw2/Ca/LbFSL_1 | cgcaccggggatcctaggcttttggat | 261 | 445 |
| 2 | S_targ_GPCnc_Lsh/Lw2/Ca/LbFSL_2 | tgcttatcgtgatcacgggtatcaaggc | 262 | 446 |
| 3 | S_targ_GPCnc_Lsh/Lw2/Ca/LbFSL_3 | agtcagtggagtttgatatgtcacatct | 263 | 447 |
| 4 | S_targ_GPCnc_Lsh/Lw2/Ca/LbFSL_4 | tgacctctgccttcaataaaaagacctt | 264 | 448 |
| 5 | S_targ_GPCnc_Lsh/Lw2/Ca/LbFSL_5 | caaatgcacaaagtgctcagagccagtg | 265 | 449 |
| 6 | S_targ_GPCnc_Lsh/Lw2/Ca/LbFSL_6 | accaatacctgattatacaaaatagaac | 266 | 450 |
| 7 | S_targ_GPCnc_Lsh/Lw2/Ca/LbFSL_7 | cttcaggggtggagaatccaggtggtta | 267 | 451 |
| 8 | S_targ_GPCnc_Lsh/Lw2/Ca/LbFSL_8 | acaaggctgctttgagtaagttcaaaga | 268 | 452 |
| 9 | S_targ_GPCnc_Lsh/Lw2/Ca/LbFSL_9 | tttggtacctagaacatgcaaagaccgg | 269 | 453 |
| 10 | S_targ_GPCnc_Lsh/Lw2/Ca/LbFSL_10 | acataaagaggcagggagtaccccct | 270 | 454 |
| 11 | S_targ_GPCnc_Lsh/Lw2/Ca/LbFSL_11 | taaccaacaaaggaatttgtagttgtgg | 271 | 455 |
| | | START OF NPnc | | |
| 1 | S_targ_NPnc_Lsh/Lw2/Ca/LbFSL_1 | cgcacagtggatcctaggcatttgattg | 272 | 456 |
| 2 | S_targ_NPnc_Lsh/Lw2/Ca/LbFSL_2 | tgtcattaaggatgcaaccaaccttctg | 273 | 457 |
| 3 | S_targ_NPnc_Lsh/Lw2/Ca/LbFSL_3 | aaagtcaacatcaaagaagaatgttttg | 274 | 458 |
| 4 | S_targ_NPnc_Lsh/Lw2/Ca/LbFSL_4 | aacacagcaactagaccaaagatctcag | 275 | 459 |
| 5 | S_targ_NPnc_Lsh/Lw2/Ca/LbFSL_5 | ggcttgtatggccaaacagtcacagact | 276 | 460 |
| 6 | S_targ_NPnc_Lsh/Lw2/Ca/LbFSL_6 | acagcagtccagcatcaacatttctggc | 277 | 461 |
| 7 | S_targ_NPnc_Lsh/Lw2/Ca/LbFSL_7 | ggccaagagaaaactcaacatgtttgtt | 278 | 462 |
| 8 | S_targ_NPnc_Lsh/Lw2/Ca/LbFSL_8 | aacaattgatctcacaagcgagaaacct | 279 | 463 |
| 9 | S_targ_NPnc_Lsh/Lw2/Ca/LbFSL_9 | gattgacattgagggtagatttaatgat | 280 | 464 |
| 10 | S_targ_NPnc_Lsh/Lw2/Ca/LbFSL_10 | cctcttcaatgcgcaacccgggttgacc | 281 | 465 |
| 11 | S_targ_NPnc_Lsh/Lw2/Ca/LbFSL_11 | cagggaagcttcgagggagtatgaagac | 282 | 466 |
| 12 | S_targ_NPnc_Lsh/Lw2/Ca/LbFSL_12 | caaagcaaggctcccagatctgaaaact | 283 | 467 |

Figure 5:
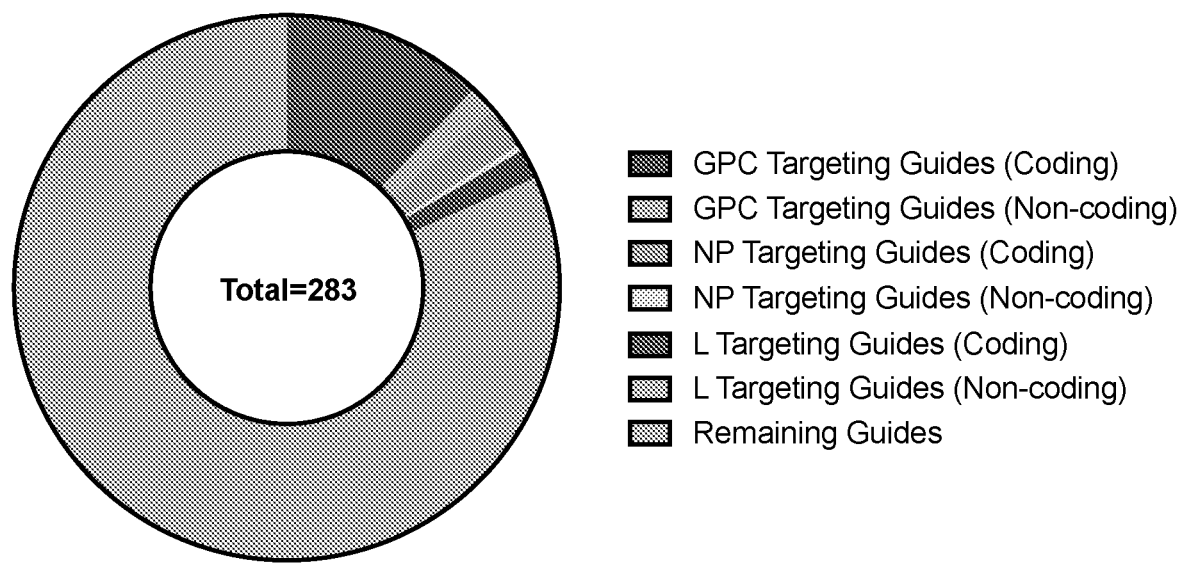
FIG. 5—Fraction of guides reducing viral replication. Mean GFP fluorescence 48 hours post LCMV infection was calculated from 3 replicates for all quides. Fold-change for each LCMV targeting guide was calculated as the ratio of the mean fluorescence of the control guide over the LCMV targeting guide. P values were calculated using a 2 tailed, unpaired t.test. Targeting guides were considered any guide with a p value less than or equal to 0.05 and fold change (FC) greater than or equal to 2. The pie chart plots the data displayed in the table with wedges corresponding to the non-coding and coding region of LCMV's 4 proteins. Remaining guides are those LCMV targeting guides that do not pass the p value and FC threshold.
Figure 6:
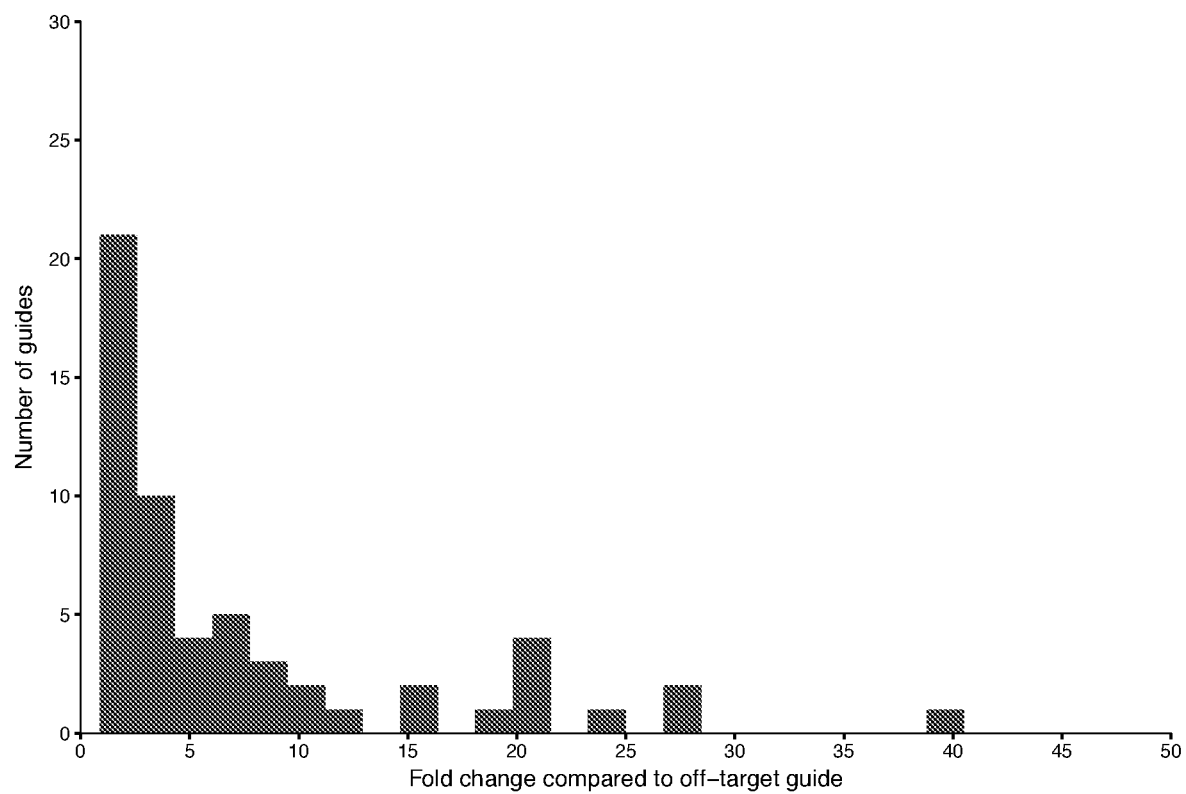
FIG. 6—Distribution of targeting efficiency of targeting guides. The distribution of fold change of GFP fluorescence (control guide over LCMV targeting guide) for guides that passed a p-value threshold of 0.05. Not shown on this graph, 8 guides with GFP fluorescence reduction greater than 50 fold (* 8 guides show reduction >50 fold).
Figure 7A:
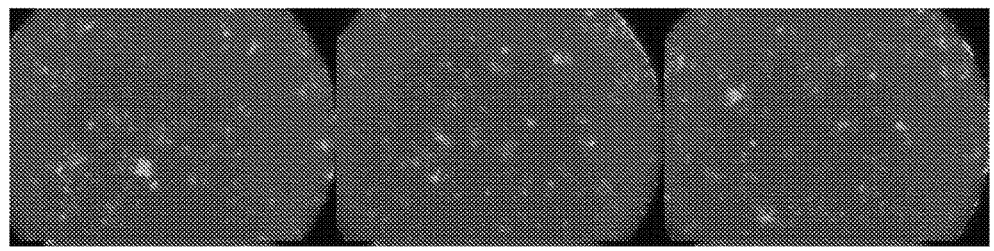
FIGS. 7A and 7B—Representative images (3 replicates for each guide) illustrating the reduction of GFP (i.e. LCMV replication) for (FIG. 7B) Guide targeting the coding region of L (#104) compared to (FIG. 7A) the control (empty guide vector). Images were taken 48 hours post LCMV infection at magnification of 4×. Fold change 2.72, p value 0.047.
Figure 7B:
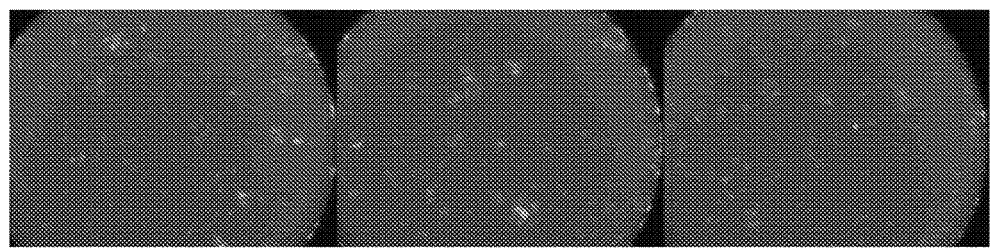
Figure 8:
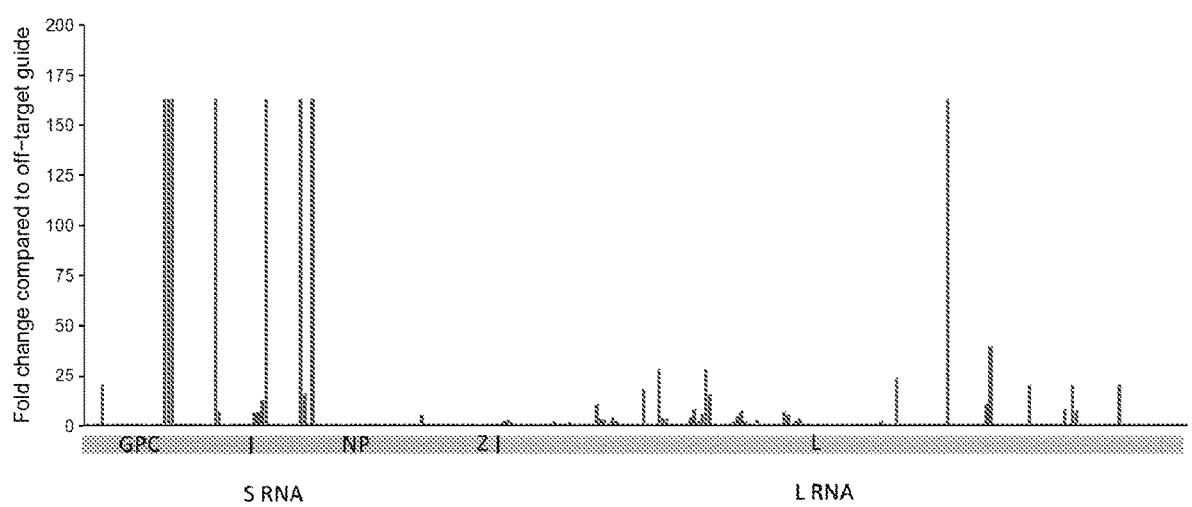
FIG. 8—Fold change of GFP fluorescence 48 hours post infection of control guide over LCMV-targeting guide for all guides that passed a p-value threshold of 0.05 and fold change threshold of 2. Each position on the x-axis is a guide that was tested in LCMV full-genome screen. Any guide that did not pass this threshold was plotted as 1. For any guide with fluorescence less than or at background, the fold change is set as the maximum fold change observed.
Figures 9A, 9B, 9C:
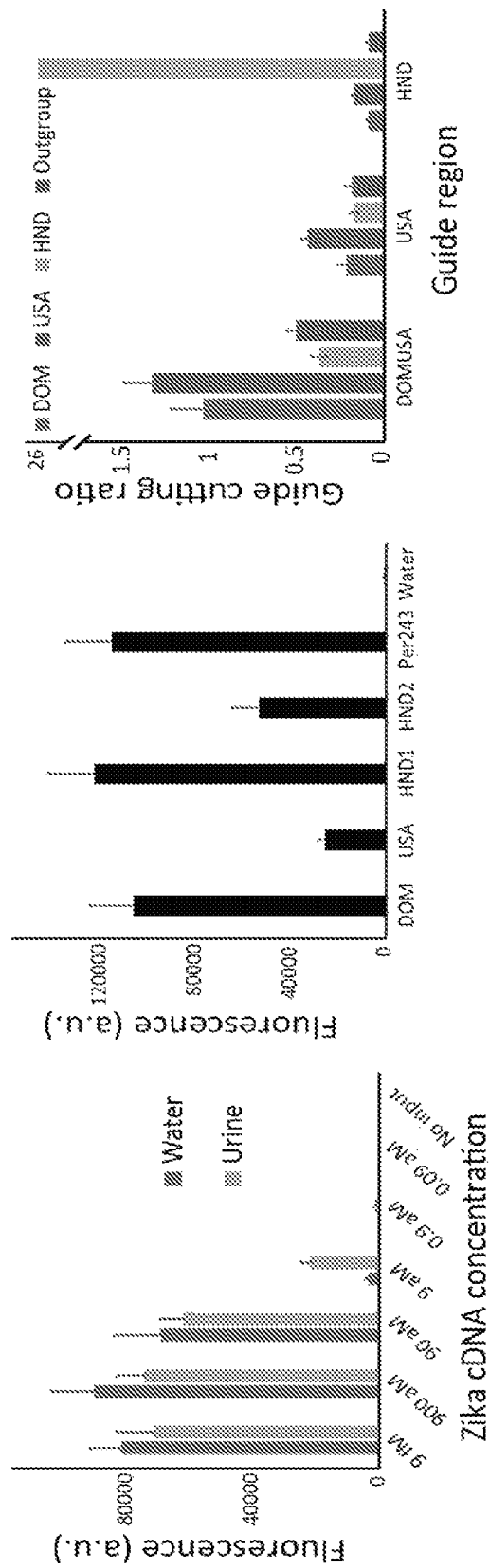
FIGS. 9A-9C—Cas13a-based diagnostics can sensitively detect Zika virus nucleic acid. Zika virus cDNA was serially diluted in healthy human urine and water, inactivated endogenous human RNases, and used the SHERLOCK protocol to quantify viral cDNA (FIG. 9A). Several cDNA samples were also tested from patient urine or serum (FIG. 9B), and a combination of guide RNAs were used to distinguish between patient sample collected from different countries during the Zika virus outbreak (FIG. 9C). Error bars indicate one standard deviation. Abbreviations: DOM=Dominican Republic, DOMUSA=Dominican Republic/USA, HND=Honduras, USA=United State of America.

To perform the screen, HEK293FT cells were reverse transfected with a plasmid encoding Cas13a with BFP fluorescence and a plasmid encoding a single guide using lipofectamine 2000. Three control guides were also reverse transfected: 1 empty vector, and 2 off-target guides. Twenty-four hours after transfection, cells were infected with a GFP-expressing LCMV at an MOI 1 for 1 hour. Viral replication, as measured by GFP fluorescence, was then measured 48 hours post infection (72 hours post reverse transfection). The fraction of guides which reduce viral replication is provided in FIG. 5 and Table 14 below. The amount of viral reduction, as measured by fold change in GFP fluorescence, is provided in FIG. 6. FIGS. 7A and 7B provide representative images illustrating the reduction of GFP. From FIG. 8 it is clear that targeting guides cluster along the LCMV genome.

TABLE 14

| Protein | Total guides tested | Total targeting guides | Targeting guides (in coding region) | Targeting guides (in non-coding region) |
|---|---|---|---|---|
| GPC | 43 | 6 | 5 | 1 |
| NP | 47 | 8 | 7 | 1 |
| Z | 11 | 0 | 0 | 0 |
| L | 182 | 39 | 34 | 5 |
| Totals | 283 | 53 | 46 | 7 |

Various modifications and variations of the described methods, pharmaceutical compositions, and kits of the invention will be apparent to those skilled in the art without departing from the scope and spirit of the invention.

Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (467 sequences)

SEQ ID NO: 1 - protein, 1434 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 2 - protein, 1197 aa, Leptotrichia wadeii
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnospiraceae bacterium
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnospiraceae bacterium
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeriaceae bacterium
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus; identical to SEQ ID NO: 14

SEQ ID NO: 16 - protein, 1159 aa, Leptorichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 17 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 18 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 19 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 20 - protein, 1334 aa, Lachnospiraceae bacterium
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 21 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 22 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 23 - protein, 1235 aa, Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 24 - protein, 1312 aa, Pseudobutyrivibrio sp.
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 25 - protein, 1343 aa, Butyrivibrio sp.
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 26 - protein, 1276 aa, Blautia sp.
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 27 - protein, 1168 aa, Leptotrichia sp.
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 28 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 29 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 30 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 31 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 32 - protein, 1001 aa, Artificial Sequence
  Synthetic Peptide
  misc_feature (7)..(9): Xaa can be any naturally occurring amino acid
  misc_feature (11)..(11): Xaa can be any naturally occurring amino acid
  misc_feature (14)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (42)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  MISC_FEATURE (90)..(90): "N" represents Isoleucine or Leucine
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (116)..(116): Xaa can be any naturally occurring amino acid
  misc_feature (121)..(121): Xaa can be any naturally occurring amino acid
  misc_feature (128)..(130): Xaa can be any naturally occurring amino acid
  misc_feature (133)..(133): Xaa can be any naturally occurring amino acid
  misc_feature (145)..(145): Xaa can be any naturally occurring amino acid
  misc_feature (148)..(148): Xaa can be any naturally occurring amino acid
  misc_feature (167)..(167): Xaa can be any naturally occurring amino acid
  misc_feature (174)..(174): Xaa can be any naturally occurring amino acid
  misc_feature (192)..(192): Xaa can be any naturally occurring amino acid
  misc_feature (194)..(195): Xaa can be any naturally occurring amino acid
  misc_feature (199)..(199): Xaa can be any naturally occurring amino acid
  misc_feature (202)..(203): Xaa can be any naturally occurring amino acid
  misc_feature (206)..(206): Xaa can be any naturally occurring amino acid
  misc_feature (217)..(219): Xaa can be any naturally occurring amino acid
  misc_feature (228)..(228): Xaa can be any naturally occurring amino acid
  misc_feature (233)..(233): Xaa can be any naturally occurring amino acid
  MISC_FEATURE (236)..(236): "N" represents Isoleucine or Leucine
  misc_feature (243)..(243): Xaa can be any naturally occurring amino acid
  misc_feature (245)..(245): Xaa can be any naturally occurring amino acid
  misc_feature (262)..(262): Xaa can be any naturally occurring amino acid
  MISC_FEATURE (267)..(267): "N" represents Isoleucine or Leucine
  misc_feature (277)..(278): Xaa can be any naturally occurring amino acid
  misc_feature (282)..(282): Xaa can be any naturally occurring amino acid
  misc_feature (287)..(287): Xaa can be any naturally occurring amino acid
  misc_feature (307)..(307): Xaa can be any naturally occurring amino acid
  misc_feature (314)..(314): Xaa can be any naturally occurring amino acid
  misc_feature (320)..(321): Xaa can be any naturally occurring amino acid
  misc_feature (333)..(333): Xaa can be any naturally occurring amino acid
  misc_feature (343)..(343): Xaa can be any naturally occurring amino acid
  misc_feature (357)..(357): Xaa can be any naturally occurring amino acid
  misc_feature (367)..(367): Xaa can be any naturally occurring amino acid
  misc_feature (371)..(371): Xaa can be any naturally occurring amino acid
  misc_feature (374)..(375): Xaa can be any naturally occurring amino acid
  misc_feature (378)..(378): Xaa can be any naturally occurring amino acid
  misc_feature (392)..(392): Xaa can be any naturally occurring amino acid
  misc_feature (402)..(402): Xaa can be any naturally occurring amino acid
  misc_feature (414)..(415): Xaa can be any naturally occurring amino acid
  MISC_FEATURE (418)..(418): "N" represents Isoleucine or Leucine
  misc_feature (446)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (467)..(467): Xaa can be any naturally occurring amino acid
  misc_feature (489)..(489): Xaa can be any naturally occurring amino acid
  misc_feature (500)..(500): Xaa can be any naturally occurring amino acid
  misc_feature (510)..(510): Xaa can be any naturally occurring amino acid
  misc_feature (514)..(514): Xaa can be any naturally occurring amino acid
  misc_feature (528)..(529): Xaa can be any naturally occurring amino acid
  misc_feature (532)..(532): Xaa can be any naturally occurring amino acid
  misc_feature (539)..(539): Xaa can be any naturally occurring amino acid
  misc_feature (547)..(548): Xaa can be any naturally occurring amino acid
  misc_feature (551)..(551): Xaa can be any naturally occurring amino acid
  misc_feature (553)..(554): Xaa can be any naturally occurring amino acid
  misc_feature (565)..(565): Xaa can be any naturally occurring amino acid
  misc_feature (576)..(576): Xaa can be any naturally occurring amino acid
  misc_feature (587)..(588): Xaa can be any naturally occurring amino acid
  misc_feature (600)..(600): Xaa can be any naturally occurring amino acid
  misc_feature (604)..(605): Xaa can be any naturally occurring amino acid
  misc_feature (622)..(622): Xaa can be any naturally occurring amino acid
  misc_feature (627)..(627): Xaa can be any naturally occurring amino acid
  misc_feature (629)..(629): Xaa can be any naturally occurring amino acid
  misc_feature (655)..(655): Xaa can be any naturally occurring amino acid
  misc_feature (662)..(662): Xaa can be any naturally occurring amino acid
  misc_feature (682)..(682): Xaa can be any naturally occurring amino acid
  misc_feature (686)..(686): Xaa can be any naturally occurring amino acid
  MISC_FEATURE (688)..(688): "N" represents Isoleucine or Leucine
  misc_feature (691)..(691): Xaa can be any naturally occurring amino acid
  misc_feature (698)..(698): Xaa can be any naturally occurring amino acid
  misc_feature (706)..(706): Xaa can be any naturally occurring amino acid
  misc_feature (723)..(723): Xaa can be any naturally occurring amino acid
  MISC_FEATURE (737)..(737): "N" represents Isoleucine or Leucine
  misc_feature (738)..(738): Xaa can be any naturally occurring amino acid
  misc_feature (760)..(761): Xaa can be any naturally occurring amino acid
  misc_feature (771)..(771): Xaa can be any naturally occurring amino acid
  misc_feature (773)..(773): Xaa can be any naturally occurring amino acid
  misc_feature (779)..(779): Xaa can be any naturally occurring amino acid
  misc_feature (786)..(786): Xaa can be any naturally occurring amino acid
  misc_feature (790)..(790): Xaa can be any naturally occurring amino acid
  misc_feature (798)..(798): Xaa can be any naturally occurring amino acid
  misc_feature (800)..(800): Xaa can be any naturally occurring amino acid
  misc_feature (834)..(834): Xaa can be any naturally occurring amino acid
  misc_feature (843)..(843): Xaa can be any naturally occurring amino acid
  misc_feature (851)..(852): Xaa can be any naturally occurring amino acid
  misc_feature (866)..(866): Xaa can be any naturally occurring amino acid
  misc_feature (870)..(870): Xaa can be any naturally occurring amino acid
  misc_feature (873)..(873): Xaa can be any naturally occurring amino acid
  misc_feature (877)..(877): Xaa can be any naturally occurring amino acid
  misc_feature (889)..(889): Xaa can be any naturally occurring amino acid
  misc_feature (896)..(896): Xaa can be any naturally occurring amino acid
  misc_feature (916)..(916): Xaa can be any naturally occurring amino acid
  misc_feature (923)..(923): Xaa can be any naturally occurring amino acid
  misc_feature (936)..(936): Xaa can be any naturally occurring amino acid
  misc_feature (962)..(962): Xaa can be any naturally occurring amino acid
  misc_feature (966)..(966): Xaa can be any naturally occurring amino acid
  misc_feature (970)..(970): Xaa can be any naturally occurring amino acid
  misc_feature (985)..(985): Xaa can be any naturally occurring amino acid
  misc_feature (996)..(996): Xaa can be any naturally occurring amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXXKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKXLKYYFPXKXAKNSNDKIFEKQELKKXWIHQXENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKXGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYXGKXLDFEKKXMKDLAELXPYDQNDGENPIVNRNIXLAKKYGTLNLLEKXXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 33 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 34 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 35 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 36 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 37 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 38 - protein, 953 aa, Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 39 - protein, 1322 aa, Prevotella sp.
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 40 - protein, 1322 aa, Prevotella sp.; identical to SEQ ID NO: 39

SEQ ID NO: 41 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 42 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 43 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 44 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 45 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 46 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 47 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 48 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 49 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 50 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 51 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 52 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 53 - protein, 1175 aa, Porphyromonas sp.
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 54 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 55 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 56 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 57 - protein, 1127 aa, Prevotella buccae; identical to SEQ ID NO: 35

SEQ ID NO: 58 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 59 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 60 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 61 - protein, 1224 aa, Bergeyella zoohelcum; identical to SEQ ID NO: 33

SEQ ID NO: 62 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 63 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 64 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 65 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 66 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 67 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 68 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 69 - protein, 1161 aa, Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 70 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 71 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 72 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 73 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 74 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 75 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 76 - protein, 1125 aa, Prevotella pallens; identical to SEQ ID NO: 58

SEQ ID NO: 77 - protein, 1157 aa, Myroides odoratimimus; identical to SEQ ID NO: 59

SEQ ID NO: 78 - protein, 1157 aa, Myroides odoratimimus; identical to SEQ ID NO: 60

SEQ ID NO: 79 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 80 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 81 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 82 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 83 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 84 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 85 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 86 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 87 - protein, 1135 aa, Porphyromonas gingivalis; identical to SEQ ID NO: 65

SEQ ID NO: 88 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 89 - protein, 1135 aa, Porphyromonas gingivalis; identical to SEQ ID NO: 66

SEQ ID NO: 90 - protein, 1135 aa, Porphyromonas gingivalis; identical to SEQ ID NO: 67

SEQ ID NO: 91 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 92 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 93 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 94 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 95 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 96 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 97 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 98 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 99 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 100 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 101 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 102 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 103 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 104 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 105 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 106 - protein, 1131 aa, Prevotella sp.
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 107 - protein, 1155 aa, Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 108 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 109 - protein, 1145 aa, Chryseobacterium sp.
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 110 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 111 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 112 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 113 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 114 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 115 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 116 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 117 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 118 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 119 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 120 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 121 - protein, 1115 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 122 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 123 - protein, 1110 aa, Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 124 - protein, 668 aa, Fusobacterium necrophorum
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 125 - protein, 1121 aa, Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 126 - protein, 897 aa, Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 127 - protein, 1111 aa, Anaerosalibacter sp.
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 128 - protein, 1340 aa, Lachnospiraceae bacterium; identical to SEQ ID NO: 4

SEQ ID NO: 129 - protein, 1437 aa, Lachnospiraceae bacterium; identical to SEQ ID NO: 5

SEQ ID NO: 130 - protein, 1385 aa, Clostridium aminophilum; identical to SEQ ID NO: 6

SEQ ID NO: 131 - protein, 1175 aa, Carnobacterium gallinarum; identical to SEQ ID NO: 7

SEQ ID NO: 132 - protein, 1164 aa, Carnobacterium gallinarum; identical to SEQ ID NO: 8

SEQ ID NO: 133 - protein, 1154 aa, Paludibacter propionicigenes; identical to SEQ ID NO: 9

SEQ ID NO: 134 - protein, 970 aa, Listeria weihenstephanensis; identical to SEQ ID NO: 10

SEQ ID NO: 135 - protein, 1051 aa, Listeriaceae bacterium; identical to SEQ ID NO: 11

SEQ ID NO: 136 - protein, 1152 aa, Leptotrichia wadei; identical to SEQ ID NO: 12

SEQ ID NO: 137 - protein, 1285 aa, Rhodobacter capsulatus; identical to SEQ ID NO: 13

SEQ ID NO: 138 - protein, 1285 aa, Rhodobacter capsulatus; identical to SEQ ID NO: 14

SEQ ID NO: 139 - protein, 1285 aa, Rhodobacter capsulatus; identical to SEQ ID NO: 14

SEQ ID NO: 140 - protein, 1389 aa, Artificial Sequence
  Synthetic Peptide
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 141 - protein, 1197 aa, Leptotrichia wadei; identical to SEQ ID NO: 2

SEQ ID NO: 142 - protein, 1120 aa, Listeria seeligeri; identical to SEQ ID NO: 3

SEQ ID NO: 143 - protein, 7 aa, Simian virus 40
PKKKRKV

SEQ ID NO: 144 - protein, 16 aa, Artificial Sequence
  Synthetic Peptide
KRPAATKKAGQAKKKK

SEQ ID NO: 145 - protein, 9 aa, Artificial Sequence
  Synthetic Peptide
PAAKRVKLD

SEQ ID NO: 146 - protein, 11 aa, Artificial Sequence
  Synthetic Peptide
RQRRNELKRSP

SEQ ID NO: 147 - protein, 38 aa, Artificial Sequence
  Synthetic Peptide
NQSSNFGPMKGGNFGGRSSGPYGGGGQYFAKPRNQGGY

SEQ ID NO: 148 - protein, 42 aa, Artificial Sequence
  Synthetic Peptide
RMRIZFKNKGKDTAELRRRRVEVSVELRKAKKDEQILKRRNV

SEQ ID NO: 149 - protein, 8 aa, Artificial Sequence
  Synthetic Peptide
VSRKRPRP

SEQ ID NO: 150 - protein, 8 aa, Artificial Sequence
  Synthetic Peptide
PPKKARED

SEQ ID NO: 151 - protein, 8 aa, Homo sapiens
  MISC_FEATURE (2)..(2): X represents pyrrolysine
PXPKKKPL

SEQ ID NO: 152 - protein, 12 aa, Mus sp.
SALIKKKKKMAP

SEQ ID NO: 153 - protein, 5 aa, Influenza virus
DRLRR

SEQ ID NO: 154 - protein, 7 aa, Influenza virus
PKQKKRK

SEQ ID NO: 155 - protein, 10 aa, Hepatitis virus
RKLKKKIKKL

SEQ ID NO: 156 - protein, 10 aa, Mus sp.
REKKKFLKRR

SEQ ID NO: 157 - protein, 20 aa, Homo sapiens
KRKGDEVDGVDEVAKKKSKK

SEQ ID NO: 158 - protein, 17 aa, Homo sapiens
RKCLQAGMNLEARKTKK

SEQ ID NO: 159 - protein, 11 aa, Homo sapiens
LYPERLRRILT

SEQ ID NO: 160 - DNA, 33 bp, Homo sapiens
ctgtaccctgagcggctgcggcggatcctgacc

SEQ ID NO: 161 - DNA, 15 bp, Homo sapiens
ggggsggggsggggs

SEQ ID NO: 162 - DNA, 30 bp, Homo sapiens
ggggsggggsggggsggggsggggsggggs

SEQ ID NO: 163 - DNA, 45 bp, Homo sapiens
ggggsggggsggggsggggsggggsggggsggggsggggsggggs

SEQ ID NO: 164 - DNA, 60 bp, Homo sapiens
ggggsggggsggggsggggsggggsggggsggggsggggsggggsggggsggggsggggs

SEQ ID NO: 165 - DNA, 20 bp, Artificial Sequence
  Synthetic Oligonucleotide
gagtccgagcagaagaagaa

SEQ ID NO: 166 - DNA, 20 bp, Artificial Sequence
  Synthetic Oligonucleotide
gagtcctagcaggagaagaa

SEQ ID NO: 167 - DNA, 20 bp, Artificial Sequence
  Synthetic Oligonucleotide
gagtctaagcagaagaagaa

SEQ ID NO: 168 - protein, 12 aa, Artificial Sequence
  Synthetic Peptide
FWYHKMILVAGC

SEQ ID NO: 169 - protein, 12 aa, Artificial Sequence
  Synthetic Peptide
WYHKREDCSTNQ

SEQ ID NO: 170 - protein, 9 aa, Artificial Sequence
  Synthetic Peptide
VCAGSPTND

SEQ ID NO: 171 - protein, 4 aa, Artificial Sequence
  Synthetic Peptide
FWYH

SEQ ID NO: 172 - protein, 5 aa, Artificial Sequence
  Synthetic Peptide
HKRED

SEQ ID NO: 173 - DNA, 28 bp, Artificial Sequence
  Synthetic Oligonucleotide
ctcacgaagaaagttgtgcaaccaaaca

SEQ ID NO: 174 - DNA, 28 bp, Artificial Sequence
  Synthetic Oligonucleotide
tcttcaatctggttggtaatggatattt

SEQ ID NO: 175 - DNA, 28 bp, Artificial Sequence
  Synthetic Oligonucleotide
gccaatttgttagtgtcctctataaatt

SEQ ID NO: 176 - DNA, 28 bp, Artificial Sequence
  Synthetic Oligonucleotide
tatctcacagaccctatttgattttgcc

SEQ ID NO: 177 - DNA, 28 bp, Artificial Sequence
  Synthetic Oligonucleotide
aaattcttcattaaattcaccatttttg

SEQ ID NO: 178 - DNA, 28 bp, Artificial Sequence
  Synthetic Oligonucleotide
tatagtttaaacataactctctcaattc

SEQ ID NO: 179 - DNA, 28 bp, Artificial Sequence
  Synthetic Oligonucleotide
atccaaaaagcctaggatccccggtgcg

SEQ ID NO: 180 - DNA, 28 bp, Artificial Sequence
  Synthetic Oligonucleotide
agaatgtcaagttgtattggatggttat

SEQ ID NO: 181 - DNA, 28 bp, Artificial Sequence
  Synthetic Oligonucleotide
aaagcagccttgttgtagtcaattagtc

SEQ ID NO: 182 - DNA, 28 bp, Artificial Sequence
  Synthetic Oligonucleotide
tgatctctttcttctttttgtcccttac

SEQ ID NO: 183 - DNA, 28 bp, Artificial Sequence
  Synthetic Oligonucleotide
tctctttcttctttttgtcccttactat

SEQ ID NO: 184 - DNA, 28 bp, Artificial Sequence
  Synthetic Oligonucleotide
caatcaaatgcctaggatccactgtgcg

SEQ ID NO: 185 - DNA, 28 bp, Artificial Sequence
  Synthetic Oligonucleotide
gttactcttcgtagggaggtggagagct

SEQ ID NO: 186 - DNA, 28 bp, Artificial Sequence
  Synthetic Oligonucleotide
ctggttggtaatggatatttacaaagag

SEQ ID NO: 187 - DNA, 28 bp, Artificial Sequence
  Synthetic Oligonucleotide
cagaaggtttaaacagtgcctgcaaagg

SEQ ID NO: 188 - DNA, 28 bp, Artificial Sequence
  Synthetic Oligonucleotide
agctgtcaaatttctgccagcaagattt

SEQ ID NO: 189 - DNA, 28 bp, Artificial Sequence
  Synthetic Oligonucleotide
gtggtatctggtaggatttcggccctgt

SEQ ID NO: 190 - DNA, 28 bp, Artificial Sequence
  Synthetic Oligonucleotide
ctctctggacttgccttgacccatcgct

SEQ ID NO: 191 - DNA, 28 bp, Artificial Sequence
  Synthetic Oligonucleotide
agcctcacgaagaaagttgtgcaaccaa

SEQ ID NO: 192 - DNA, 28 bp, Artificial Sequence
  Synthetic Oligonucleotide
tcagtcgatgtcctcggccaccgacccg

SEQ ID NO: 193 - DNA, 28 bp, Artificial Sequence
  Synthetic Oligonucleotide
tccccttgagtctaaacctgccccccac

SEQ ID NO: 194 - DNA, 28 bp, Artificial Sequence
  Synthetic Oligonucleotide
ctagatttgctaaaacaaagtctgcaat

SEQ ID NO: 195 - DNA, 28 bp, Artificial Sequence
  Synthetic Oligonucleotide
caaaagcgacagtggaatcagcagaata

SEQ ID NO: 196 - DNA, 28 bp, Artificial Sequence
  Synthetic Oligonucleotide
ggaggattacacttatctctgaacccaa

SEQ ID NO: 197 - DNA, 28 bp, Artificial Sequence
  Synthetic Oligonucleotide
cgatgcaggaagaggttcccaaggacat

SEQ ID NO: 198 - DNA, 28 bp, Artificial Sequence
  Synthetic Oligonucleotide
aagtcctgctagaaagactttcatgtcc

SEQ ID NO: 199 - DNA, 28 bp, Artificial Sequence
  Synthetic Oligonucleotide
tattttggacaaggtttcttccttcaaa

SEQ ID NO: 200 - DNA, 28 bp, Artificial Sequence
  Synthetic Oligonucleotide
agtggcacaggctcccactcaggtccaa

SEQ ID NO: 201 - DNA, 28 bp, Artificial Sequence
  Synthetic Oligonucleotide
aatcccatccagtattcttttggagccc

SEQ ID NO: 202 - DNA, 28 bp, Artificial Sequence
  Synthetic Oligonucleotide
caccaagtatcaagggatcttccatgta

SEQ ID NO: 203 - DNA, 28 bp, Artificial Sequence
  Synthetic Oligonucleotide
atatcaaagacaccatcgttcaccttga

SEQ ID NO: 204 - DNA, 28 bp, Artificial Sequence
  Synthetic Oligonucleotide
gtggaggcattcatccaacattcttcta

SEQ ID NO: 205 - DNA, 28 bp, Artificial Sequence
  Synthetic Oligonucleotide
gagagcatgataaaagttcagccacacc

SEQ ID NO: 206 - DNA, 28 bp, Artificial Sequence
  Synthetic Oligonucleotide
accaagaatatcaatgaaaatttcctta

SEQ ID NO: 207 - DNA, 28 bp, Artificial Sequence
  Synthetic Oligonucleotide
gtgcgtaaagtccactgaaattgaaaac

SEQ ID NO: 208 - DNA, 28 bp, Artificial Sequence
  Synthetic Oligonucleotide
tgagcatgtagtcccacagatcctttaa

SEQ ID NO: 209 - DNA, 28 bp, Artificial Sequence
  Synthetic Oligonucleotide
gtcaggccctgcctaatcaacatggcag

SEQ ID NO: 210 - DNA, 28 bp, Artificial Sequence
  Synthetic Oligonucleotide
tcggtaagagaaccacccaaaaccaaac

SEQ ID NO: 211 - DNA, 28 bp, Artificial Sequence
  Synthetic Oligonucleotide
gcctctccacatttttgttcaccacctt

SEQ ID NO: 212 - DNA, 28 bp, Artificial Sequence
  Synthetic Oligonucleotide
cccagtgcctcagcaccatcttcagatg

SEQ ID NO: 213 - DNA, 28 bp, Artificial Sequence
  Synthetic Oligonucleotide
ccatgaaaaattgcctaatgtcctggtt

SEQ ID NO: 214 - DNA, 28 bp, Artificial Sequence
  Synthetic Oligonucleotide
atgattcaaaatacacctgttttaagaa

SEQ ID NO: 215 - DNA, 28 bp, Artificial Sequence
  Synthetic Oligonucleotide
ctaacaacaaattcatcaaccagactgg

SEQ ID NO: 216 - DNA, 28 bp, Artificial Sequence
  Synthetic Oligonucleotide
ggcaaggtcagaaaacagaacagtgtaa

SEQ ID NO: 217 - DNA, 28 bp, Artificial Sequence
  Synthetic Oligonucleotide
caacatgagaaatgagtgacaaggattc

SEQ ID NO: 218 - DNA, 28 bp, Artificial Sequence
  Synthetic Oligonucleotide
cagaggtcaaggaatttaattctgggac

SEQ ID NO: 219 - DNA, 28 bp, Artificial Sequence
  Synthetic Oligonucleotide
catgtcagacataaatggaagaagctga

SEQ ID NO: 220 - DNA, 28 bp, Artificial Sequence
  Synthetic Oligonucleotide
accgcctcacagattgaatcacttggtt

SEQ ID NO: 221 - DNA, 28 bp, Artificial Sequence
  Synthetic Oligonucleotide
agccttgagctctcaggctttcttgcta

SEQ ID NO: 222 - DNA, 28 bp, Artificial Sequence
  Synthetic Oligonucleotide
cttaagagttaggttctcactgttattc

SEQ ID NO: 223 - DNA, 28 bp, Artificial Sequence
  Synthetic Oligonucleotide
ggacccaaacacccaactcaaaagagtt

SEQ ID NO: 224 - DNA, 28 bp, Artificial Sequence
  Synthetic Oligonucleotide
tcccaaagaagaggccttaaaaggcata

SEQ ID NO: 225 - DNA, 28 bp, Artificial Sequence
  Synthetic Oligonucleotide
atgagactgtttgtcacaaatgtacagc

SEQ ID NO: 226 - DNA, 28 bp, Artificial Sequence
  Synthetic Oligonucleotide
ctcttgtcacatgatcatctgtggttag

SEQ ID NO: 227 - DNA, 28 bp, Artificial Sequence
  Synthetic Oligonucleotide
tacagattttccctatttttgtttctca

SEQ ID NO: 228 - DNA, 28 bp, Artificial Sequence
  Synthetic Oligonucleotide
gcaaaggcctataaagccagatgagata

SEQ ID NO: 229 - DNA, 28 bp, Artificial Sequence
  Synthetic Oligonucleotide
tgattgcttctgacagcagcttctgtgc

SEQ ID NO: 230 - DNA, 28 bp, Artificial Sequence
  Synthetic Oligonucleotide
agtttgttctggagtgtcttgatcaatg

SEQ ID NO: 231 - DNA, 28 bp, Artificial Sequence
  Synthetic Oligonucleotide
agtcatcactgatggataaaccaccttt

SEQ ID NO: 232 - DNA, 28 bp, Artificial Sequence
  Synthetic Oligonucleotide
ggaacatttcattcaaattcaaccagtt

SEQ ID NO: 233 - DNA, 28 bp, Artificial Sequence
  Synthetic Oligonucleotide
tcttcttcaagaccgaggaggtctccca

SEQ ID NO: 234 - DNA, 28 bp, Artificial Sequence
  Synthetic Oligonucleotide
atctctgttaaataggtctaagaaaaat

SEQ ID NO: 235 - DNA, 28 bp, Artificial Sequence
  Synthetic Oligonucleotide
tgagcttatgatgcagtttccttacaag

SEQ ID NO: 236 - DNA, 28 bp, Artificial Sequence
  Synthetic Oligonucleotide
ttaggacacagttcctcaatgagtcttt

SEQ ID NO: 237 - DNA, 28 bp, Artificial Sequence
  Synthetic Oligonucleotide
atccagccaatctttcacatcagtgttg

SEQ ID NO: 238 - DNA, 28 bp, Artificial Sequence
  Synthetic Oligonucleotide
aagggaaattggcatactttaggaggtc

SEQ ID NO: 239 - DNA, 28 bp, Artificial Sequence
  Synthetic Oligonucleotide
ttaactagggagactgggacgccatttg

SEQ ID NO: 240 - DNA, 28 bp, Artificial Sequence
  Synthetic Oligonucleotide
atctattgtttcacaaagttgatgtggc

SEQ ID NO: 241 - DNA, 28 bp, Artificial Sequence
  Synthetic Oligonucleotide
gcgctgcagatacaaactttgtgagaag

SEQ ID NO: 242 - DNA, 28 bp, Artificial Sequence
  Synthetic Oligonucleotide
tagaatctagatttaaattctgcagcga

SEQ ID NO: 243 - DNA, 28 bp, Artificial Sequence
  Synthetic Oligonucleotide
gctgataaatttgtttaacaagccgctc

SEQ ID NO: 244 - DNA, 28 bp, Artificial Sequence
  Synthetic Oligonucleotide
ggacaaggacttcctccggatcacttac

SEQ ID NO: 245 - DNA, 28 bp, Artificial Sequence
  Synthetic Oligonucleotide
tcaaataaagtgatctgatcatcacttg

SEQ ID NO: 246 - DNA, 28 bp, Artificial Sequence
  Synthetic Oligonucleotide
gccaaagataacaccaatgcagtagttg

SEQ ID NO: 247 - DNA, 28 bp, Artificial Sequence
  Synthetic Oligonucleotide
catagaagtcagaagcattatgcaagat

SEQ ID NO: 248 - DNA, 28 bp, Artificial Sequence
  Synthetic Oligonucleotide
ctggatatatgggatggcactatcccca

SEQ ID NO: 249 - DNA, 28 bp, Artificial Sequence
  Synthetic Oligonucleotide
tctctcagtaacagttgtttctgaaccc

SEQ ID NO: 250 - DNA, 28 bp, Artificial Sequence
  Synthetic Oligonucleotide
tgacatatgatttcatcattgcattcac

SEQ ID NO: 251 - DNA, 28 bp, Artificial Sequence
  Synthetic Oligonucleotide
agcttatgcatgtgccaagttaacaaag

SEQ ID NO: 252 - DNA, 28 bp, Artificial Sequence
  Synthetic Oligonucleotide
acgcacatactggtcatcacctagtttg

SEQ ID NO: 253 - DNA, 28 bp, Artificial Sequence
  Synthetic Oligonucleotide
acaaaaatgggcacatcattggtcccca

SEQ ID NO: 254 - DNA, 28 bp, Artificial Sequence
  Synthetic Oligonucleotide
tttaagaacccttcccgcacattgatag

SEQ ID NO: 255 - DNA, 28 bp, Artificial Sequence
  Synthetic Oligonucleotide
aaattccttatcattgtttaaacaggag

SEQ ID NO: 256 - DNA, 28 bp, Artificial Sequence
  Synthetic Oligonucleotide
actcaaaataatcttctattaaccttgt

SEQ ID NO: 257 - DNA, 28 bp, Artificial Sequence
  Synthetic Oligonucleotide
ccaatatagagttctctatttcccccaa

SEQ ID NO: 258 - DNA, 28 bp, Artificial Sequence
  Synthetic Oligonucleotide
aaatttcagccttccagagtcaggacct

SEQ ID NO: 259 - DNA, 28 bp, Artificial Sequence
  Synthetic Oligonucleotide
attcttctgagtagaagcacagattttt

SEQ ID NO: 260 - DNA, 28 bp, Artificial Sequence
  Synthetic Oligonucleotide
gtcaacgacagagctttactaagggact

SEQ ID NO: 261 - DNA, 28 bp, Artificial Sequence
  Synthetic Oligonucleotide
gattctcacgtcttcttccagtttgtcc

SEQ ID NO: 262 - DNA, 28 bp, Artificial Sequence
  Synthetic Oligonucleotide
cttgcctttgcatatgcctgtatttccc

SEQ ID NO: 263 - DNA, 28 bp, Artificial Sequence
  Synthetic Oligonucleotide
tgcaacagaatcatcttcatgcaagaaa

SEQ ID NO: 264 - DNA, 28 bp, Artificial Sequence
  Synthetic Oligonucleotide
ctttctacaaaggttttttgccatctca

SEQ ID NO: 265 - DNA, 28 bp, Artificial Sequence
  Synthetic Oligonucleotide
tgactgaggtgaaatacaaaggtgacag

SEQ ID NO: 266 - DNA, 28 bp, Artificial Sequence
  Synthetic Oligonucleotide
tcacagataaatttcatgtcatcattgg

SEQ ID NO: 267 - DNA, 28 bp, Artificial Sequence
  Synthetic Oligonucleotide
ttctactaaatggaaagatatttctgac

SEQ ID NO: 268 - DNA, 28 bp, Artificial Sequence
  Synthetic Oligonucleotide
ccatcttccctgttagaataagctgtaa

SEQ ID NO: 269 - DNA, 28 bp, Artificial Sequence
  Synthetic Oligonucleotide
gtaagtttttctccatctcctttgtcat

SEQ ID NO: 270 - DNA, 28 bp, Artificial Sequence
  Synthetic Oligonucleotide
ccgtgctattgtggtgttgaccttttct

SEQ ID NO: 271 - DNA, 28 bp, Artificial Sequence
  Synthetic Oligonucleotide
tctcttcttctccatcaaaacatatttc

SEQ ID NO: 272 - DNA, 28 bp, Artificial Sequence
  Synthetic Oligonucleotide
cctgtctcttctcccttggaaccgatga

SEQ ID NO: 273 - DNA, 28 bp, Artificial Sequence
  Synthetic Oligonucleotide
aactttatattcatagtctgagtggctc

SEQ ID NO: 274 - DNA, 28 bp, Artificial Sequence
  Synthetic Oligonucleotide
cgaaactctccgtaatttgactcacagc

SEQ ID NO: 275 - DNA, 28 bp, Artificial Sequence
  Synthetic Oligonucleotide
tcatattccagaagtcgttctccattta

SEQ ID NO: 276 - DNA, 28 bp, Artificial Sequence
  Synthetic Oligonucleotide
tttgttactagcaagatctaatgctgtc

SEQ ID NO: 277 - DNA, 28 bp, Artificial Sequence
  Synthetic Oligonucleotide
gatctaggctgtttagcttcttctctcc

SEQ ID NO: 278 - DNA, 28 bp, Artificial Sequence
  Synthetic Oligonucleotide
ttaaatgaagacaccattaggctaaagg

SEQ ID NO: 279 - DNA, 28 bp, Artificial Sequence
  Synthetic Oligonucleotide
tgtatgctgacagtcaatttctttacta

SEQ ID NO: 280 - DNA, 28 bp, Artificial Sequence
  Synthetic Oligonucleotide
agaacacacattcttcctcaggagtgat

SEQ ID NO: 281 - DNA, 28 bp, Artificial Sequence
  Synthetic Oligonucleotide
aaaccaaattgacttttgggctcaaaga

SEQ ID NO: 282 - DNA, 28 bp, Artificial Sequence
  Synthetic Oligonucleotide
atctgttagcctgtcaggggtctccttt

SEQ ID NO: 283 - DNA, 28 bp, Artificial Sequence
  Synthetic Oligonucleotide
acacattcaacataaatttaaattttgc

SEQ ID NO: 284 - DNA, 28 bp, Artificial Sequence
  Synthetic Oligonucleotide
gtaccaaaaatagtttttattaggaatc

SEQ ID NO: 285 - DNA, 28 bp, Artificial Sequence
  Synthetic Oligonucleotide
ctcagcaggtgtgatcagatcctccctc

SEQ ID NO: 286 - DNA, 28 bp, Artificial Sequence
  Synthetic Oligonucleotide
atgagaaatctgacactattgccatcac

SEQ ID NO: 287 - DNA, 28 bp, Artificial Sequence
  Synthetic Oligonucleotide
tgcttttgatttctctttgttgggttgg

SEQ ID NO: 288 - DNA, 28 bp, Artificial Sequence
  Synthetic Oligonucleotide
cctcagtgcaacctcaatgtcggtgaga

SEQ ID NO: 289 - DNA, 28 bp, Artificial Sequence
  Synthetic Oligonucleotide
atctaatccatgaaatcatgatgtctat

SEQ ID NO: 290 - DNA, 28 bp, Artificial Sequence
  Synthetic Oligonucleotide
gaaaaaattggtaaaaagaaccttttag

SEQ ID NO: 291 - DNA, 28 bp, Artificial Sequence
  Synthetic Oligonucleotide
atgaccatccgggccttgtatggagtag

SEQ ID NO: 292 - DNA, 28 bp, Artificial Sequence
  Synthetic Oligonucleotide
tctggtataataggtggtattcttcaga

SEQ ID NO: 293 - DNA, 28 bp, Artificial Sequence
  Synthetic Oligonucleotide
aacacttctttgcattctaccacttgat

SEQ ID NO: 294 - DNA, 28 bp, Artificial Sequence
  Synthetic Oligonucleotide
ttgccttagtctagcaactgagctagtt

SEQ ID NO: 295 - DNA, 28 bp, Artificial Sequence
  Synthetic Oligonucleotide
gacaaacagatgataatcttctcaggct

SEQ ID NO: 296 - DNA, 28 bp, Artificial Sequence
  Synthetic Oligonucleotide
gtgctgggttggaaattgtaatcttcaa

SEQ ID NO: 297 - DNA, 28 bp, Artificial Sequence
  Synthetic Oligonucleotide
gtgagctccaattttcataaagttctca

SEQ ID NO: 298 - DNA, 28 bp, Artificial Sequence
  Synthetic Oligonucleotide
attcttgctcaaggtgttcagacagtcc

SEQ ID NO: 299 - DNA, 28 bp, Artificial Sequence
  Synthetic Oligonucleotide
accactaacaggcatttttgaatttttg

SEQ ID NO: 300 - DNA, 28 bp, Artificial Sequence
  Synthetic Oligonucleotide
cctaaacaattcctcaaaagacaccttt

SEQ ID NO: 301 - DNA, 28 bp, Artificial Sequence
  Synthetic Oligonucleotide
tattcctcaaaagtctaatgaactcctc

SEQ ID NO: 302 - DNA, 28 bp, Artificial Sequence
  Synthetic Oligonucleotide
agcctatcattcacactactatagcaac

SEQ ID NO: 303 - DNA, 28 bp, Artificial Sequence
  Synthetic Oligonucleotide
ttttaaccctttgaatttcgactgtttt

SEQ ID NO: 304 - DNA, 28 bp, Artificial Sequence
  Synthetic Oligonucleotide
catccagatttaacaactgtctccttct

SEQ ID NO: 305 - DNA, 28 bp, Artificial Sequence
  Synthetic Oligonucleotide
ttgactttgtttaacatagagaggagcc

SEQ ID NO: 306 - DNA, 28 bp, Artificial Sequence
  Synthetic Oligonucleotide
acttcccctttcgtgcccatgggtctct

SEQ ID NO: 307 - DNA, 28 bp, Artificial Sequence
  Synthetic Oligonucleotide
gacaggattccactgcctccctgcttaa

SEQ ID NO: 308 - DNA, 28 bp, Artificial Sequence
  Synthetic Oligonucleotide
gcaaggttttcatagagctcagagaatt

SEQ ID NO: 309 - DNA, 28 bp, Artificial Sequence
  Synthetic Oligonucleotide
tactttctgaaagtttctctttaatttc

SEQ ID NO: 310 - DNA, 28 bp, Artificial Sequence
  Synthetic Oligonucleotide
acctgctgaaaagagagtttattccaaa

SEQ ID NO: 311 - DNA, 28 bp, Artificial Sequence
  Synthetic Oligonucleotide
ttggggttgatgccttcgtggcacatcc

SEQ ID NO: 312 - DNA, 28 bp, Artificial Sequence
  Synthetic Oligonucleotide
tgacctcgcatctttcagaattttcata

SEQ ID NO: 313 - DNA, 28 bp, Artificial Sequence
  Synthetic Oligonucleotide
cgatagtagtcttcagggactcacagag

SEQ ID NO: 314 - DNA, 28 bp, Artificial Sequence
  Synthetic Oligonucleotide
aagactttctcattttggttagaatact

SEQ ID NO: 315 - DNA, 28 bp, Artificial Sequence
  Synthetic Oligonucleotide
tctaaatttgaagtttgcccactctggc

SEQ ID NO: 316 - DNA, 28 bp, Artificial Sequence
  Synthetic Oligonucleotide
aacgaccatctactattggaactaatgt

SEQ ID NO: 317 - DNA, 28 bp, Artificial Sequence
  Synthetic Oligonucleotide
tccctgatgcatgccaatttgttagtgt

SEQ ID NO: 318 - DNA, 28 bp, Artificial Sequence
  Synthetic Oligonucleotide
actggctggagtgctcctaacaaaacac

SEQ ID NO: 319 - DNA, 28 bp, Artificial Sequence
  Synthetic Oligonucleotide
ctatcagcttgtaaccatcaggaatgat

SEQ ID NO: 320 - DNA, 28 bp, Artificial Sequence
  Synthetic Oligonucleotide
attccagactccaccaaaattgtttcca

SEQ ID NO: 321 - DNA, 28 bp, Artificial Sequence
  Synthetic Oligonucleotide
tgtgcagccactcttgtctgcactgtct

SEQ ID NO: 322 - DNA, 28 bp, Artificial Sequence
  Synthetic Oligonucleotide
acttgagtccctcaatcagaaccattct

SEQ ID NO: 323 - DNA, 28 bp, Artificial Sequence
  Synthetic Oligonucleotide
ttgagtttctgccttgacaacctctcat

SEQ ID NO: 324 - DNA, 28 bp, Artificial Sequence
  Synthetic Oligonucleotide
taactctctcaattctgagatgatttca

SEQ ID NO: 325 - DNA, 28 bp, Artificial Sequence
  Synthetic Oligonucleotide
ttcagcgtcttttccagacggtttttac

SEQ ID NO: 326 - DNA, 28 bp, Artificial Sequence
  Synthetic Oligonucleotide
caactacaaattcctttgttggttaatc

SEQ ID NO: 327 - DNA, 28 bp, Artificial Sequence
  Synthetic Oligonucleotide
accttttatgtgcctgtgtgttggtatt

SEQ ID NO: 328 - DNA, 28 bp, Artificial Sequence
  Synthetic Oligonucleotide
tgactagatatgcagatgtggaaaacat

SEQ ID NO: 329 - DNA, 28 bp, Artificial Sequence
  Synthetic Oligonucleotide
ggggtactcccctgcctctttatgtaat

SEQ ID NO: 330 - DNA, 28 bp, Artificial Sequence
  Synthetic Oligonucleotide
catgttatcggcttcctgttcgatttga

SEQ ID NO: 331 - DNA, 28 bp, Artificial Sequence
  Synthetic Oligonucleotide
agtaagaaccattggtgacaagccagca

SEQ ID NO: 332 - DNA, 28 bp, Artificial Sequence
  Synthetic Oligonucleotide
gtctttgcatgttctaggtaccaaaact

SEQ ID NO: 333 - DNA, 28 bp, Artificial Sequence
  Synthetic Oligonucleotide
ccccatcagatctctcaagtggttcctc

SEQ ID NO: 334 - DNA, 28 bp, Artificial Sequence
  Synthetic Oligonucleotide
aagaattcactgttgttttgaataagtg

SEQ ID NO: 335 - DNA, 28 bp, Artificial Sequence
  Synthetic Oligonucleotide
ttgaacttactcaaagcagccttgttgt

SEQ ID NO: 336 - DNA, 28 bp, Artificial Sequence
  Synthetic Oligonucleotide
acagaattcttcatcatgatttacattg

SEQ ID NO: 337 - DNA, 28 bp, Artificial Sequence
  Synthetic Oligonucleotide
cgaaacacttaagctctgcagcaagaat

SEQ ID NO: 338 - DNA, 28 bp, Artificial Sequence
  Synthetic Oligonucleotide
ccacctggattctccacccctgaagagt

SEQ ID NO: 339 - DNA, 28 bp, Artificial Sequence
  Synthetic Oligonucleotide
gcccgctagtctcctagtgaagaactta

SEQ ID NO: 340 - DNA, 28 bp, Artificial Sequence
  Synthetic Oligonucleotide
tcctggacatcccaaaaggacctgcata

SEQ ID NO: 341 - DNA, 28 bp, Artificial Sequence
  Synthetic Oligonucleotide
ctattttgtataatcaggtattggtaac

SEQ ID NO: 342 - DNA, 28 bp, Artificial Sequence
  Synthetic Oligonucleotide
cttgccatctgagcctgtccagccccag

SEQ ID NO: 343 - DNA, 28 bp, Artificial Sequence
  Synthetic Oligonucleotide
cgaaggcagttctaaacatatctaggac

SEQ ID NO: 344 - DNA, 28 bp, Artificial Sequence
  Synthetic Oligonucleotide
tggctctgagcactttgtgcatttgaga

SEQ ID NO: 345 - DNA, 28 bp, Artificial Sequence
  Synthetic Oligonucleotide
tatgccattgttgaagtcgcaggatact

SEQ ID NO: 346 - DNA, 28 bp, Artificial Sequence
  Synthetic Oligonucleotide
tgatactgaggtgtaggctcgaaactat

SEQ ID NO: 347 - DNA, 28 bp, Artificial Sequence
  Synthetic Oligonucleotide
gtctttttattgaaggcagaggtcagat

SEQ ID NO: 348 - DNA, 28 bp, Artificial Sequence
  Synthetic Oligonucleotide
ggaatcattggtgaaggtcaattctagt

SEQ ID NO: 349 - DNA, 28 bp, Artificial Sequence
  Synthetic Oligonucleotide
aatggtgggagttgttggctgaacatgc

SEQ ID NO: 350 - DNA, 28 bp, Artificial Sequence
  Synthetic Oligonucleotide
tgtgacatatcaaactccactgacttaa

SEQ ID NO: 351 - DNA, 28 bp, Artificial Sequence
  Synthetic Oligonucleotide
gtcgggtcccttaagaccgtacatgcca

SEQ ID NO: 352 - DNA, 28 bp, Artificial Sequence
  Synthetic Oligonucleotide
ggaaactgatcaatgcgaatatcccaca

SEQ ID NO: 353 - DNA, 28 bp, Artificial Sequence
  Synthetic Oligonucleotide
ttgatacccgtgatcacgataagcacaa

SEQ ID NO: 354 - DNA, 28 bp, Artificial Sequence
  Synthetic Oligonucleotide
atcgatgatgtgaggcagagcctcaaac

SEQ ID NO: 355 - DNA, 28 bp, Artificial Sequence
  Synthetic Oligonucleotide
ttctgtaggatagggcctgacacccagt

SEQ ID NO: 356 - DNA, 25 bp, Artificial Sequence
  Synthetic Oligonucleotide
caaaaagcctaggatccccggtgcg

SEQ ID NO: 357 - DNA, 28 bp, Artificial Sequence
  Synthetic Oligonucleotide
cttagagtgtcacaacatttgggcctct

SEQ ID NO: 358 - DNA, 28 bp, Artificial Sequence
  Synthetic Oligonucleotide
atgttgtgaacagttttcagatctggga

SEQ ID NO: 359 - DNA, 28 bp, Artificial Sequence
  Synthetic Oligonucleotide
aaaaatgatgcagtccatgagtgcacag

SEQ ID NO: 360 - DNA, 28 bp, Artificial Sequence
  Synthetic Oligonucleotide
ttttgtcccttactattccagtatgcat

SEQ ID NO: 361 - DNA, 28 bp, Artificial Sequence
  Synthetic Oligonucleotide
tcccacactttgtcttcatactccctcg

SEQ ID NO: 362 - DNA, 28 bp, Artificial Sequence
  Synthetic Oligonucleotide
atcgataagcttaatgtccttcctattc

SEQ ID NO: 363 - DNA, 28 bp, Artificial Sequence
  Synthetic Oligonucleotide
tgtcatcggagccttgacagcttagaac

SEQ ID NO: 364 - DNA, 28 bp, Artificial Sequence
  Synthetic Oligonucleotide
ataactgacgaggtcaacccgggttgcg

SEQ ID NO: 365 - DNA, 28 bp, Artificial Sequence
  Synthetic Oligonucleotide
catgccgtgtgagtacttggaatcttgc

SEQ ID NO: 366 - DNA, 28 bp, Artificial Sequence
  Synthetic Oligonucleotide
gttccctgtaaaagtgtatgaactgccc

SEQ ID NO: 367 - DNA, 28 bp, Artificial Sequence
  Synthetic Oligonucleotide
atttccactggatcattaaatctaccct

SEQ ID NO: 368 - DNA, 28 bp, Artificial Sequence
  Synthetic Oligonucleotide
gttggggtcaattcctcccatgaggtct

SEQ ID NO: 369 - DNA, 28 bp, Artificial Sequence
  Synthetic Oligonucleotide
agcttaagcccacctgaggtggacctgc

SEQ ID NO: 370 - DNA, 28 bp, Artificial Sequence
  Synthetic Oligonucleotide
gagttgactgcaggtttctcgcttgtga

SEQ ID NO: 371 - DNA, 28 bp, Artificial Sequence
  Synthetic Oligonucleotide
tgctctccccacaatcgatgttctacaa

SEQ ID NO: 372 - DNA, 28 bp, Artificial Sequence
  Synthetic Oligonucleotide
ctgaaaggcaaactttatagaggatgtt

SEQ ID NO: 373 - DNA, 28 bp, Artificial Sequence
  Synthetic Oligonucleotide
acttggtctgaaacaaacatgttgagtt

SEQ ID NO: 374 - DNA, 28 bp, Artificial Sequence
  Synthetic Oligonucleotide
cttcaagaggtcctcgctgttgcttggc

SEQ ID NO: 375 - DNA, 28 bp, Artificial Sequence
  Synthetic Oligonucleotide
tgttacccccatccaacagggctgcccc

SEQ ID NO: 376 - DNA, 28 bp, Artificial Sequence
  Synthetic Oligonucleotide
ctaaagttatagccagaaatgttgatgc

SEQ ID NO: 377 - DNA, 28 bp, Artificial Sequence
  Synthetic Oligonucleotide
ccccagaactgggtgcttgtctttcagc

SEQ ID NO: 378 - DNA, 28 bp, Artificial Sequence
  Synthetic Oligonucleotide
gatacttgactgtgtaaagcaagccaag

SEQ ID NO: 379 - DNA, 28 bp, Artificial Sequence
  Synthetic Oligonucleotide
tcattgagcggagtctgtgactgtttgg

SEQ ID NO: 380 - DNA, 28 bp, Artificial Sequence
  Synthetic Oligonucleotide
tggcattgtgccaaattgattgttcaaa

SEQ ID NO: 381 - DNA, 28 bp, Artificial Sequence
  Synthetic Oligonucleotide
aaactcttaccacaccacttgcaccctg

SEQ ID NO: 382 - DNA, 28 bp, Artificial Sequence
  Synthetic Oligonucleotide
atctgtaggatctgagatctttggtcta

SEQ ID NO: 383 - DNA, 28 bp, Artificial Sequence
  Synthetic Oligonucleotide
catatatacccctgaagcctggggcctt

SEQ ID NO: 384 - DNA, 28 bp, Artificial Sequence
  Synthetic Oligonucleotide
tcagcttctcaaggtcagccgcaagaga

SEQ ID NO: 385 - DNA, 28 bp, Artificial Sequence
  Synthetic Oligonucleotide
ctccccactttcaaaacattcttctttg

SEQ ID NO: 386 - DNA, 28 bp, Artificial Sequence
  Synthetic Oligonucleotide
agaatgtacagtctggttgagacttctg

SEQ ID NO: 387 - DNA, 28 bp, Artificial Sequence
  Synthetic Oligonucleotide
ctctcttttccttcctcatgatcctctg

SEQ ID NO: 388 - DNA, 28 bp, Artificial Sequence
  Synthetic Oligonucleotide
tccaacccattcagaaggttggttgcat

SEQ ID NO: 389 - DNA, 28 bp, Artificial Sequence
  Synthetic Oligonucleotide
atctgatgtgaagctctgcaattctctt

SEQ ID NO: 390 - DNA, 28 bp, Artificial Sequence
  Synthetic Oligonucleotide
agctcttaacttccttagacaaggacat

SEQ ID NO: 391 - DNA, 28 bp, Artificial Sequence
  Synthetic Oligonucleotide
agacaaatgcgcaatcaaatgcctagga

SEQ ID NO: 392 - DNA, 28 bp, Artificial Sequence
  Synthetic Oligonucleotide
cgcaccgaggatcctaggctttttgatg

SEQ ID NO: 393 - DNA, 28 bp, Artificial Sequence
  Synthetic Oligonucleotide
ttgagggactcaagttgctgtcacgctg

SEQ ID NO: 394 - DNA, 28 bp, Artificial Sequence
  Synthetic Oligonucleotide
gttacaagctgatagacaattctctcat

SEQ ID NO: 395 - DNA, 28 bp, Artificial Sequence
  Synthetic Oligonucleotide
tagtagatggtcgttgtgattatgataa

SEQ ID NO: 396 - DNA, 28 bp, Artificial Sequence
  Synthetic Oligonucleotide
cgcaccgaggatcctaggctttttgatg

SEQ ID NO: 397 - DNA, 28 bp, Artificial Sequence
  Synthetic Oligonucleotide
ttgagggactcaagttgctgtcacgctg

SEQ ID NO: 398 - DNA, 28 bp, Artificial Sequence
  Synthetic Oligonucleotide
gttacaagctgatagacaattctctcat

SEQ ID NO: 399 - DNA, 28 bp, Artificial Sequence
  Synthetic Oligonucleotide
tagtagatggtcgttgtgattatgataa

SEQ ID NO: 400 - DNA, 28 bp, Artificial Sequence
  Synthetic Oligonucleotide
tgaagactactatcgacaagcgctccgg

SEQ ID NO: 401 - DNA, 28 bp, Artificial Sequence
  Synthetic Oligonucleotide
ctcttttcagcaggtttagaagagattt

SEQ ID NO: 402 - DNA, 28 bp, Artificial Sequence
  Synthetic Oligonucleotide
cagtggaatcctgtcctttgatgagatt

SEQ ID NO: 403 - DNA, 28 bp, Artificial Sequence
  Synthetic Oligonucleotide
tgttaaatctggatgttttgtgtctttc

SEQ ID NO: 404 - DNA, 28 bp, Artificial Sequence
  Synthetic Oligonucleotide
gacttttgaggaatagaaaaaagtcaaa

SEQ ID NO: 405 - DNA, 28 bp, Artificial Sequence
  Synthetic Oligonucleotide
accttgagcaagaatgccacataccatt

SEQ ID NO: 406 - DNA, 28 bp, Artificial Sequence
  Synthetic Oligonucleotide
tatcatctgtttgtctggccttaacaaa

SEQ ID NO: 407 - DNA, 28 bp, Artificial Sequence
  Synthetic Oligonucleotide
acctattataccagaagactggagaatc

SEQ ID NO: 408 - DNA, 28 bp, Artificial Sequence
  Synthetic Oligonucleotide
tttcatggattagatcatgtcctgattt

SEQ ID NO: 409 - DNA, 28 bp, Artificial Sequence
  Synthetic Oligonucleotide
tgtcagatttctcatctacatcattaat

SEQ ID NO: 410 - DNA, 28 bp, Artificial Sequence
  Synthetic Oligonucleotide
ttatgttgaatgtgtcatacctgtgtca

SEQ ID NO: 411 - DNA, 28 bp, Artificial Sequence
  Synthetic Oligonucleotide
aagaatgtgtgttctatgagcaaatgaa

SEQ ID NO: 412 - DNA, 28 bp, Artificial Sequence
  Synthetic Oligonucleotide
taaacagcctagatcccatgactaactc

SEQ ID NO: 413 - DNA, 28 bp, Artificial Sequence
  Synthetic Oligonucleotide
ttacggagagtttcgtaagaaaacaaaa

SEQ ID NO: 414 - DNA, 28 bp, Artificial Sequence
  Synthetic Oligonucleotide
atggagaagaagagacaagcttcttcaa

SEQ ID NO: 415 - DNA, 28 bp, Artificial Sequence
  Synthetic Oligonucleotide
taacagggaagatggctcacttaagaaa

SEQ ID NO: 416 - DNA, 28 bp, Artificial Sequence
  Synthetic Oligonucleotide
atttcacctcagtcattaaagatcagtg

SEQ ID NO: 417 - DNA, 28 bp, Artificial Sequence
  Synthetic Oligonucleotide
atatgcaaaggcaaggcttgaatttcaa

SEQ ID NO: 418 - DNA, 28 bp, Artificial Sequence
  Synthetic Oligonucleotide
tctactcagaagaatcaccaacatcata

SEQ ID NO: 419 - DNA, 28 bp, Artificial Sequence
  Synthetic Oligonucleotide
aagattattttgagtctttttcaagttt

SEQ ID NO: 420 - DNA, 28 bp, Artificial Sequence
  Synthetic Oligonucleotide
tgtgcccatttttgttcttaatgtttct

SEQ ID NO: 421 - DNA, 28 bp, Artificial Sequence
  Synthetic Oligonucleotide
tgaaatcatatgtcaagtcgaagctaaa

SEQ ID NO: 422 - DNA, 28 bp, Artificial Sequence
  Synthetic Oligonucleotide
cttctgacttctatggtttgcttagcga

SEQ ID NO: 423 - DNA, 28 bp, Artificial Sequence
  Synthetic Oligonucleotide
aggaagtccttgtcctgttggaattcca

SEQ ID NO: 424 - DNA, 28 bp, Artificial Sequence
  Synthetic Oligonucleotide
ttgtatctgcagcgctacacaatgtcaa

SEQ ID NO: 425 - DNA, 28 bp, Artificial Sequence
  Synthetic Oligonucleotide
atgccaatttccctttggatccatttct

SEQ ID NO: 426 - DNA, 28 bp, Artificial Sequence
  Synthetic Oligonucleotide
tgcatcataagctcaaaaatggtgaatt

SEQ ID NO: 427 - DNA, 28 bp, Artificial Sequence
  Synthetic Oligonucleotide
tgaatgaaatgttcccattaaggatggt

SEQ ID NO: 428 - DNA, 28 bp, Artificial Sequence
  Synthetic Oligonucleotide
tgtcagaagcaatcaacaagtcagcttt

SEQ ID NO: 429 - DNA, 28 bp, Artificial Sequence
  Synthetic Oligonucleotide
atcatgtgacaagagtttgcaatcggga

SEQ ID NO: 430 - DNA, 28 bp, Artificial Sequence
  Synthetic Oligonucleotide
tgggtgtttgggtcctagcagaaccgac

SEQ ID NO: 431 - DNA, 28 bp, Artificial Sequence
  Synthetic Oligonucleotide
aatctgtgaggcggttatatcccaagat

SEQ ID NO: 432 - DNA, 28 bp, Artificial Sequence
  Synthetic Oligonucleotide
tcatttctcatgttgttaagtggaaaag

SEQ ID NO: 433 - DNA, 28 bp, Artificial Sequence
  Synthetic Oligonucleotide
tgtattttgaatcatttgttcgagaatt

SEQ ID NO: 434 - DNA, 28 bp, Artificial Sequence
  Synthetic Oligonucleotide
aaaatgtggagaggcctatgtttaggaa

SEQ ID NO: 435 - DNA, 28 bp, Artificial Sequence
  Synthetic Oligonucleotide
gggactacatgctcaactacacaaaagg

SEQ ID NO: 436 - DNA, 28 bp, Artificial Sequence
  Synthetic Oligonucleotide
ttttatcatgctctcacctctttaaggg

SEQ ID NO: 437 - DNA, 28 bp, Artificial Sequence
  Synthetic Oligonucleotide
ccttgatacttggtgattctcttgagct

SEQ ID NO: 438 - DNA, 28 bp, Artificial Sequence
  Synthetic Oligonucleotide
accttgtccaaaatatcattgtgaagct

SEQ ID NO: 439 - DNA, 28 bp, Artificial Sequence
  Synthetic Oligonucleotide
taagtgtaatcctccaggaactatgtat

SEQ ID NO: 440 - DNA, 28 bp, Artificial Sequence
  Synthetic Oligonucleotide
ttagactcaaggggaggtcctgcgacga

SEQ ID NO: 441 - DNA, 28 bp, Artificial Sequence
  Synthetic Oligonucleotide
gtgggtgtgtgtgtgtgtgtgtgtgcgt

SEQ ID NO: 442 - DNA, 28 bp, Artificial Sequence
  Synthetic Oligonucleotide
tgttgatatcttcaatctggttggtaat

SEQ ID NO: 443 - DNA, 28 bp, Artificial Sequence
  Synthetic Oligonucleotide
taaagggccaagataggtggtatctggt

SEQ ID NO: 444 - DNA, 28 bp, Artificial Sequence
  Synthetic Oligonucleotide
caactaaacgcctaggatccccggtgcg

SEQ ID NO: 445 - DNA, 28 bp, Artificial Sequence
  Synthetic Oligonucleotide
cgcaccggggatcctaggctttttggat

SEQ ID NO: 446 - DNA, 28 bp, Artificial Sequence
  Synthetic Oligonucleotide
tgcttatcgtgatcacgggtatcaaggc

SEQ ID NO: 447 - DNA, 28 bp, Artificial Sequence
  Synthetic Oligonucleotide
agtcagtggagtttgatatgtcacatct

SEQ ID NO: 448 - DNA, 28 bp, Artificial Sequence
  Synthetic Oligonucleotide
tgacctctgccttcaataaaaagacctt

SEQ ID NO: 449 - DNA, 28 bp, Artificial Sequence
  Synthetic Oligonucleotide
caaatgcacaaagtgctcagagccagtg

SEQ ID NO: 450 - DNA, 28 bp, Artificial Sequence
  Synthetic Oligonucleotide
accaatacctgattatacaaaatagaac

SEQ ID NO: 451 - DNA, 28 bp, Artificial Sequence
  Synthetic Oligonucleotide
cttcaggggtggagaatccaggtggtta

SEQ ID NO: 452 - DNA, 28 bp, Artificial Sequence
  Synthetic Oligonucleotide
acaaggctgctttgagtaagttcaaaga

SEQ ID NO: 453 - DNA, 28 bp, Artificial Sequence
  Synthetic Oligonucleotide
tttggtacctagaacatgcaaagaccgg

SEQ ID NO: 454 - DNA, 28 bp, Artificial Sequence
  Synthetic Oligonucleotide
acataaagaggcaggggagtacccccct

SEQ ID NO: 455 - DNA, 28 bp, Artificial Sequence
  Synthetic Oligonucleotide
taaccaacaaaggaatttgtagttgtgg

SEQ ID NO: 456 - DNA, 28 bp, Artificial Sequence
  Synthetic Oligonucleotide
cgcacagtggatcctaggcatttgattg

SEQ ID NO: 457 - DNA, 28 bp, Artificial Sequence
  Synthetic Oligonucleotide
tgtcattaaggatgcaaccaaccttctg

SEQ ID NO: 458 - DNA, 28 bp, Artificial Sequence
  Synthetic Oligonucleotide
aaagtcaacatcaaagaagaatgttttg

SEQ ID NO: 459 - DNA, 28 bp, Artificial Sequence
  Synthetic Oligonucleotide
aacacagcaactagaccaaagatctcag

SEQ ID NO: 460 - DNA, 28 bp, Artificial Sequence
  Synthetic Oligonucleotide
ggcttgtatggccaaacagtcacagact

SEQ ID NO: 461 - DNA, 28 bp, Artificial Sequence
  Synthetic Oligonucleotide
acagcagtccagcatcaacatttctggc

SEQ ID NO: 462 - DNA, 28 bp, Artificial Sequence
  Synthetic Oligonucleotide
ggccaagagaaaactcaacatgtttgtt

SEQ ID NO: 463 - DNA, 28 bp, Artificial Sequence
  Synthetic Oligonucleotide
aacaattgatctcacaagcgagaaacct

SEQ ID NO: 464 - DNA, 28 bp, Artificial Sequence
  Synthetic Oligonucleotide
gattgacattgagggtagatttaatgat

SEQ ID NO: 465 - DNA, 28 bp, Artificial Sequence
  Synthetic Oligonucleotide
cctcttcaatgcgcaacccgggttgacc

SEQ ID NO: 466 - DNA, 28 bp, Artificial Sequence
  Synthetic Oligonucleotide
cagggaagcttcgagggagtatgaagac

SEQ ID NO: 467 - DNA, 28 bp, Artificial Sequence
  Synthetic Oligonucleotide
caaagcaaggctcccagatctgaaaact

The invention claimed is:

1. A Class 2, type VI CRISPR system effective to reduce a viral load in a eukaryotic subject and detect the presence of a virus, the system comprising:
   (a) a Cas13 protein and/or a polynucleic acid encoding the Cas13 protein; and
   (b) two or more guide RNAs and/or one or more polynucleic acids encoding said two or more guide RNAs that bind to one or more target viral, wherein the one or more target viral mRNAs comprise viral sequences that, when cleaved by the Cas13 protein, (i) results in the reduction in viral load for use in treating, suppressing, and/or alleviating viral pathogenesis, infection, propagation and/or replication in the subject, wherein the reduction in viral load is greater as compared to a Class 2, type VI CRISPR system having a single guide, and (ii) stimulates Cas13 protein collateral activity, and wherein the two or more guide RNAs are selected from a pool of tiled guide RNAs that are tiled across the coding strand of a viral genome starting every 50 nucleotides.

2. The CRISPR system according to claim 1, wherein (a) said polynucleic acid encoding said polynucleic acid encoding the Cas13 protein comprises a regulatory element operably linked to a polynucleic acid encoding said Cas13 protein, (b) said polynucleic acid encoding said one or more guide RNAs comprises a regulatory element operably linked to a polynucleic acid encoding said one or more guide RNAs or both (a) and (b).

3. The CRISPR system according to claim 2, wherein said regulatory element allows constitutive or inducible expression of said Cas13 protein and/or said one or more guide RNAs, optionally tissue specific expression.

4. The CRISPR system according to claim 1, wherein said polynucleic acid encoding said one or more guide RNAs and/or said polynucleic acid encoding said Cas13 protein are comprised in one or more vectors, wherein the one or more vectors are one or more eukaryotic expression vectors.

5. The CRISPR system according to claim 4, wherein said vector is a viral vector, or an adenoviral vector, or an AAV vector, or a retroviral vector.

6. The CRISPR system according to claim 1, wherein the CRISPR system is effective to reduce viremia.

7. The CRISPR system according to claim 1, wherein said subject is an animal subject, or a mammalian subject, or a human subject.

8. The CRISPR system according to claim 1, wherein the one or more target RNAs comprise sequences of or that correspond to regions of a viral genome that are less likely to evolving resistance to the one or more guide RNAs.

9. The CRISPR system according to claim 1, wherein (a) said Cas13 protein comprises one or more mutations, and wherein the one or more mutations affect catalytic activity and/or stability and/or specificity; (b) wherein said Cas13 protein is codon optimized; (c) wherein said Cas13 protein comprises a NLS or a NES; (d) wherein said Cas13 protein comprises a fusion protein; or (e) any combination of (a)-(d).

10. The CRISPR system according to claim 1, wherein the system further comprises (c) a masking construct that produces a detectable signal or modifies a detectable signal in response to Cas13 protein collateral activity.

11. The CRISPR system according to claim 1, wherein said Cas13 protein comprises one or more HEPN domains that comprise a RxxxxH motif sequence, wherein the RxxxxH motif sequence comprises a R{N/H/K}X1X2X3H sequence, and wherein X1 is R, S, D, E, Q, N, G, or Y, X2 is independently I, S, T, V, or L, and X3 is independently L, F, N, Y, V, I, S, D, E, or A.

12. The CRISPR system according to claim 1, wherein the Cas13 protein is Cas13a, Cas13b, or Cas 13c.

13. The CRISPR system according to claim 12, wherein the Cas13 protein is from an organism of a genus selected from the group consisting of: *Leptotrichia, Listeria*, Corynebacter, *Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*;

or wherein the Cas13 protein is from an organism selected from the group consisting of: *Leptotrichia shahii; Leptotrichia wadei* (Lw2); *Listeria seeligeri*; Lachnospiraceae bacterium MA2020; Lachnospiraceae bacterium NK4A179; *Clostridium aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*;

*Eubacterium rectale*; Eubacteriaceae bacterium CHKCI004; *Blautia* sp. Marseille-P2398; and *Leptotrichia* sp. oral taxon 879 str. F0557, Lachnospiraceae bacterium NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; Porphyromonadaceae bacterium KH3CP3RA; *Listeria riparia*; and *Insolitispirillum peregrimim*; or wherein the Cas13 protein is a *L. wadei* F0279 Cas13a protein.

14. The CRISPR system according to claim 1, wherein the two or more guide RNAs designed to bind to the one or more target molecules comprise a synthetic mismatch, and wherein said mismatch is up- or downstream of a SNP or other single nucleotide variation in said target molecule.

15. The CRISPR system according to claim 1, wherein the guide RNAs comprise a pan-viral guide RNA set that targets each virus and/or viral strain in a set of viruses.

16. The CRISPR system according to claim 1, wherein the virus is a DNA virus, or a single stranded, or double stranded DNA virus, or a positive sense DNA virus, or a negative sense DNA virus, or an antisense DNA virus.

17. The CRISPR system according to claim 16, wherein the virus is a Myoviridae, Podoviridae, Siphoviridae, Alloherpesviridae, Herpesviridae (including human herpes virus, and Varicella Zoster virus), Malocoherpesviridae, Lipothrixviridae, Rudiviridae, Adenoviridae, Ampullaviridae, Ascoviridae, Asfarviridae, Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae, Poxviridae, Sphaerolipoviridae, Tectiviridae, Turriviridae, Dinodnavirus, Salterprovirus, Rhizidovirus, or any combination thereof; or Simian virus 40, JC virus, or BK virus; or cowpox or smallpox; or African swine fever virus; or Human herpes virus or varicella Zoster virus.

18. The CRISPR system according to claim 1, wherein the virus is a single-stranded, or double-stranded RNA virus, or a positive sense RNA virus, or a negative sense RNA virus, or an antisense RNA virus.

19. The CRISPR system according to claim 18, wherein the virus is a Retroviridae virus, Lentiviridae virus, Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus; or wherein the virus is Lymphocytic choriomeningitis virus, Coronavirus, HIV, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

20. A pharmaceutical composition comprising:
the CRISPR system as defined in claim 1; and
a pharmaceutically acceptable excipient.

21. The pharmaceutical formulation of claim 20, wherein the pharmaceutical formulation is (a) effective to treat, prevent, suppress, and/or alleviate viral pathogenesis, infection, propagation, and/or replication in a subject; (b) is effective to reduce viremia, viral load, or viral titer in a subject; or both (a) and (b).

22. The CRISPR system according to claim 1, wherein said two or more guide RNAs is three or more, four or more, or five or more gRNAs.

23. The CRISPR system according to claim 1, wherein each of the said two or more guide RNAs bind to different target sequences.

24. The CRISPR system according to claim 1, wherein said two or more guide RNAs are selected based on prior diagnosis or detection of the virus, and wherein said diagnosis or detection comprises identifying a particular viral mutation or nucleotide variation.

25. The CRISPR system according to claim 24, wherein said diagnosis or detection comprises identifying a particular viral strain or particular viral drug resistance.

26. The CRISPR system according to claim 24, wherein said diagnosis or detection comprises a companion or complementary diagnostic method.

27. A Class 2, type VI CRISPR system effective to reduce a viral load in a subject and detect the presence of a virus, the system consisting essentially of:
(a) a Cas13 protein and/or a polynucleic acid encoding the Cas13 protein;
(b) one or more guide RNAs and/or one or more polynucleic acids encoding said one or more guide RNAs that bind to one or more target viral mRNAs or that are encoded by a coding DNA strand of the viral genome, wherein the one or more target viral mRNAs comprise viral sequences that, when cleaved by the Cas13 protein, (i) results in the reduction in viral load for use in treating, suppressing, and/or alleviating viral pathogenesis, infection, propagation and/or replication in a subject, wherein the reduction in viral load is greater as compared to a Class 2, type VI CRISPR system having a single guide, and (ii) stimulates Cas13 protein collateral activity, and wherein the two or more guide RNAs are selected from a pool of tiled guide RNAs that are tiled across the coding strand of a viral genome starting every 50 nucleotides.

28. A Class 2, type VI CRISPR system effective to reduce a viral load in a subject, the system consisting essentially of:
(a) a Cas13 protein and/or a polynucleic acid encoding the Cas13 protein;
(b) two or more guide RNAs and/or one or more polynucleic acids encoding said two or more guide RNAs that to bind to one or more target viral mRNAs or that are encoded by a coding DNA strand of the viral genome, wherein the one or more target viral mRNA comprise viral sequences that, when cleaved by the Cas13 protein, (i) results in the reduction in viral load for use in treating, suppressing, and/or alleviating viral pathogenesis, infection, propagation and/or replication in a subject, wherein the reduction in viral load is greater as compared to a Class 2, type VI CRISPR system having a single guide, and (ii) stimulates Cas13 protein collateral activity, and wherein the two or more guide RNAs are selected from a pool of tiled guide RNAs that are tiled across the coding strand of a viral genome starting every 50 nucleotides.

29. A method for treating, suppressing, and/or alleviating viral pathogenesis, infection, propagation and/or replication and detection of a virus in a eukaryotic subject, comprising administering to a subject in need thereof the system of claim 1.

30. The method according to claim 29, wherein (a) said polynucleic acid encoding said Cas13 protein comprises a regulatory element operably linked to a polynucleic acid encoding said Cas13 protein, (b) said polynucleic acid encoding said two or more guide RNAs comprises a regulatory element operably linked to a polynucleic acid encoding said two or more guide RNAs, or both (a) and (b).

31. The method according to claim 30, wherein said regulatory element allows constitutive or inducible expression of said Cas13 protein and/or said two or more guide RNAs.

32. The method of claim 31, wherein the constitutive or inducible expression is tissue specific expression.

33. The method according to claim 29, wherein said polynucleic acid encoding said two or more guide RNAs and/or said Cas13 protein are comprised in one or more eukaryotic expression vectors.

34. The method according to claim 33, wherein said vector is a viral vector, or an adenoviral vector, or an AAV vector, or a retroviral vector.

35. The method according to claim 29, wherein the method reduces viremia in the subject.

36. The method according to claim 29, wherein said subject is an animal subject, or a mammalian subject, or a human subject.

37. The method according to claim 29, wherein the one or more target RNAs are part of said virus or are transcribed from a DNA molecule of said virus.

38. The method according to claim 29, wherein the Cas13 protein cleaves the one or more target RNAs.

39. The method according to claim 29, wherein the Cas13 protein comprises one or more mutations that affect catalytic activity and/or stability and/or specificity.

40. The method according to claim 29, wherein the Cas13 protein is codon optimized, wherein said Cas13 protein optionally comprises a NLS or a NES, and wherein said Cas13 protein optionally comprises a fusion protein.

41. The method according to claim 29, wherein said Cas13 protein comprises one or more HEPN domains that comprises a RxxxxH motif sequence, wherein the RxxxxH motif sequence comprises a R{N/H/K}X$_1$X$_2$X$_3$H sequence, and wherein X$_1$ is R, S, D, E, Q, N, G, or Y, X$_2$ is independently I, S, T, V, or L, and X$_3$ is independently L, F, N, Y, V, I, S, D, E, or A.

42. The method according to claim 29, wherein the Cas13 protein is from an organism of a genus selected from the group consisting of: *Listeria*, Corynebacter, *Sutterella*, *Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*;

or wherein the Cas13 protein is from an organism selected from the group consisting of: *Leptotrichia shahii; Leptotrichia wadei* (Lw2); *Listeria seeligeri*; Lachnospiraceae bacterium MA2020; Lachnospiraceae bacterium NK4A179; *Clostridium aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica; Eubacterium rectale*; Eubacteriaceae bacterium CHKCI004; *Blautia* sp. Marseille-P2398; and *Leptotrichia* sp. oral taxon 879 str. F0557, Lachnospiraceae bacterium NK4A144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; Porphyromonadaceae bacterium KH3CP3RA; *Listeria riparia*; and *Insolitispirillum peregrinum*; or wherein the Cas13 protein is a *L. wadei* F0279 Cas13a protein.

43. The method according to claim 29, wherein the two or more guide RNAs designed to bind to the one or more target RNAs comprise a synthetic mismatch up- or downstream of a SNP or other single nucleotide variation in said one or more target RNAs.

44. The CRISPR system according to claim 29, wherein the two or more guide RNAs comprise a pan-viral guide RNA set that targets each virus and/or viral strain in a set of viruses.

45. The method according to claim 29, wherein the virus is a DNA virus, or a single-stranded, or double-stranded DNA virus, or a positive sense DNA virus, or a negative sense DNA virus, or an antisense DNA virus.

46. The method according to claim 45, wherein the virus is a Myoviridae, Podoviridae, Siphoviridae, Alloherpesviridae, Herpesviridae, Malocoherpesviridae, Lipothrixviridae, Rudiviridae, Adenoviridae, Ampullaviridae, Ascoviridae, Asfarviridae, Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae, Poxviridae, Sphaerolipoviridae, Tectiviridae, Turriviridae, Dinodnavirus, Salterprovirus, Rhizidovirus, or any combination thereof; or Simian virus 40, JC virus, or BK virus; or cowpox or smallpox; or African swine fever virus; or Human herpes virus or varicella Zoster virus.

47. The method according to claim 29, wherein the virus is an RNA virus, or a single-stranded, or double-stranded RNA virus, or wherein the virus is a positive sense RNA virus, or a negative sense RNA virus, or an antisense RNA virus.

48. The method according to claim 47, wherein the virus is a Retroviridae virus, Lentiviridae virus, Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus; or wherein the virus is Lymphocytic choriomeningitis virus, Coronavirus, HIV, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

49. The method according to claim 29, wherein said two or more guide RNAs is or more, four or more, or five or more gRNAs.

50. The method according to claim 49, wherein each of the two or more said guide RNAs bind to different target sequences.

51. The method according to claim 49, wherein said two or more guide RNAs are selected based on prior diagnosis or detection of the virus, and wherein said diagnosis or detection comprises identifying a particular viral mutation or nucleotide variation.

\* \* \* \* \*